(12) United States Patent
Doudna et al.

(10) Patent No.: US 10,000,772 B2
(45) Date of Patent: *Jun. 19, 2018

(54) METHODS AND COMPOSITIONS FOR RNA-DIRECTED TARGET DNA MODIFICATION AND FOR RNA-DIRECTED MODULATION OF TRANSCRIPTION

(71) Applicants: The Regents of the University of California, Oakland, CA (US); University of Vienna, Vienna (AT); Emmanuelle Charpentier, Braunschweig (DE)

(72) Inventors: Jennifer A. Doudna, Berkeley, CA (US); Martin Jinek, Berkeley, CA (US); Emmanuelle Charpentier, Braunschweig (DE); Krzysztof Chylinski, Vienna (AT)

(73) Assignees: The Regents of the University of California, Oakland, CA (US); University of Vienna, Vienna (AT); Emmanuelle Charpentier, Braunschweig (DE)

( * ) Notice: Subject to any disclaimer, the term of this patent is extended or adjusted under 35 U.S.C. 154(b) by 0 days. days.

This patent is subject to a terminal disclaimer.

(21) Appl. No.: 14/685,502

(22) Filed: Apr. 13, 2015

(65) Prior Publication Data

US 2016/0130608 A1    May 12, 2016

Related U.S. Application Data

(63) Continuation of application No. 13/842,859, filed on Mar. 15, 2013.

(60) Provisional application No. 61/765,576, filed on Feb. 15, 2013, provisional application No. 61/757,640, filed on Jan. 28, 2013, provisional application No. 61/716,256, filed on Oct. 19, 2012, provisional application No. 61/652,086, filed on May 25, 2012.

(51) Int. Cl.
| | |
|---|---|
| *C12N 9/22* | (2006.01) |
| *C12N 15/10* | (2006.01) |
| *C12N 15/11* | (2006.01) |
| *C12N 15/113* | (2010.01) |
| *C12N 15/90* | (2006.01) |
| *C12N 15/70* | (2006.01) |
| *C12N 15/74* | (2006.01) |
| *C12N 15/63* | (2006.01) |

(52) U.S. Cl.
CPC ............ *C12N 15/907* (2013.01); *C12N 9/22* (2013.01); *C12N 15/102* (2013.01); *C12N 15/111* (2013.01); *C12N 15/113* (2013.01); *C12N 15/63* (2013.01); *C12N 15/70* (2013.01); *C12N 15/746* (2013.01); *C12N 15/90* (2013.01); *C12N 15/902* (2013.01); *C12N 2310/11* (2013.01); *C12N 2310/13* (2013.01); *C12N 2310/20* (2017.05); *C12N 2310/3519* (2013.01); *C12N 2310/531* (2013.01); *C12N 2800/80* (2013.01); *C12Y 301/04* (2013.01)

(58) Field of Classification Search
None
See application file for complete search history.

(56) References Cited

U.S. PATENT DOCUMENTS

| | | | |
|---|---|---|---|
| 5,766,900 A | 6/1998 | Shillito et al. | |
| 5,767,367 A | 6/1998 | Dudits et al. | |
| 7,534,819 B2 | 5/2009 | Albarran et al. | |
| 7,691,995 B2 | 4/2010 | Zamore et al. | |
| 7,745,609 B2 * | 6/2010 | Bennett ............... | C07K 14/003 536/23.1 |
| 8,546,553 B2 | 10/2013 | Terns et al. | |
| 8,697,359 B1 | 4/2014 | Zhang | |
| 8,771,945 B1 | 7/2014 | Zhang | |
| 8,795,965 B2 | 8/2014 | Zhang | |

(Continued)

FOREIGN PATENT DOCUMENTS

| | | |
|---|---|---|
| CN | 103224947 A | 7/2013 |
| CN | 103233028 A | 8/2013 |

(Continued)

OTHER PUBLICATIONS

Briner et al. (2014) Guide RNA Functional Modules Direct Cas9 Activity and Orthogonality. Molecular Cell, 56:333-339.*

(Continued)

*Primary Examiner* — Neil P Hammell
(74) *Attorney, Agent, or Firm* — Bozicevic, Field & Francis LLP

(57) ABSTRACT

The present disclosure provides a DNA-targeting RNA that comprises a targeting sequence and, together with a modifying polypeptide, provides for site-specific modification of a target DNA and/or a polypeptide associated with the target DNA. The present disclosure further provides site-specific modifying polypeptides. The present disclosure further provides methods of site-specific modification of a target DNA and/or a polypeptide associated with the target DNA The present disclosure provides methods of modulating transcription of a target nucleic acid in a target cell, generally involving contacting the target nucleic acid with an enzymatically inactive Cas9 polypeptide and a DNA-targeting RNA. Kits and compositions for carrying out the methods are also provided. The present disclosure provides genetically modified cells that produce Cas9; and Cas9 transgenic non-human multicellular organisms.

11 Claims, 128 Drawing Sheets

(56) References Cited

U.S. PATENT DOCUMENTS

| | | |
|---|---|---|
| 8,865,406 B2 | 10/2014 | Zhang et al. |
| 8,871,445 B2 | 10/2014 | Cong et al. |
| 8,889,356 B2 | 11/2014 | Zhang |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,921,332 B2 | 12/2014 | Choulika et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 9,023,649 B2 | 5/2015 | Mali et al. |
| 2002/0119570 A1 | 8/2002 | Yoon et al. |
| 2002/0182673 A1 | 12/2002 | Chen et al. |
| 2003/0186238 A1 | 10/2003 | Allawi et al. |
| 2003/0232410 A1 | 12/2003 | Liljedahl et al. |
| 2004/0111221 A1 | 6/2004 | Beattie et al. |
| 2005/0026157 A1 | 2/2005 | Baltimore et al. |
| 2005/0208489 A1 | 9/2005 | Carroll et al. |
| 2006/0199190 A1 | 9/2006 | Russell et al. |
| 2006/0234247 A1 | 10/2006 | Puttaraju |
| 2006/0253913 A1 | 11/2006 | Huang et al. |
| 2007/0016012 A1 | 1/2007 | Hartlep et al. |
| 2007/0134796 A1 | 6/2007 | Holmes et al. |
| 2007/0218528 A1 | 9/2007 | Miller et al. |
| 2008/0124725 A1 | 5/2008 | Barrangou et al. |
| 2008/0159996 A1 | 7/2008 | Ando et al. |
| 2009/0227029 A1 | 9/2009 | Radman et al. |
| 2010/0034924 A1 | 2/2010 | Fremaux et al. |
| 2010/0047805 A1 | 2/2010 | Wang et al. |
| 2010/0055728 A1 | 3/2010 | Yang et al. |
| 2010/0055798 A1 | 3/2010 | Battersby |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2011/0002889 A1 | 1/2011 | Barrangou et al. |
| 2011/0082093 A1 | 4/2011 | Gregory et al. |
| 2011/0145940 A1 | 6/2011 | Voytas et al. |
| 2011/0182867 A1 | 7/2011 | Orkin et al. |
| 2011/0189776 A1 | 8/2011 | Terns et al. |
| 2011/0207221 A1 | 8/2011 | Cost et al. |
| 2011/0217739 A1 | 9/2011 | Terns et al. |
| 2011/0223638 A1 | 9/2011 | Wiedenheft et al. |
| 2011/0236530 A1 | 9/2011 | Manoury et al. |
| 2011/0287545 A1 | 11/2011 | Cost et al. |
| 2011/0294114 A1 | 12/2011 | Van Der Loo et al. |
| 2011/0300538 A1 | 12/2011 | Barrangou et al. |
| 2011/0301073 A1 | 12/2011 | Gregory et al. |
| 2012/0029891 A1 | 2/2012 | Behlke et al. |
| 2012/0192298 A1 | 7/2012 | Weinstein et al. |
| 2013/0011828 A1 | 1/2013 | Barrangou et al. |
| 2013/0130248 A1 | 5/2013 | Haurwitz et al. |
| 2013/0158245 A1 | 6/2013 | Russell et al. |
| 2013/0253040 A1 | 9/2013 | Miller et al. |
| 2013/0288251 A1 | 10/2013 | Horvath et al. |
| 2013/0309670 A1 | 11/2013 | Frendewey et al. |
| 2013/0326645 A1 | 12/2013 | Cost et al. |
| 2013/0326725 A1 | 12/2013 | Shukla et al. |
| 2013/0330778 A1 | 12/2013 | Gusti et al. |
| 2014/0017212 A1 | 1/2014 | Rebar et al. |
| 2014/0017214 A1 | 1/2014 | Cost |
| 2014/0045176 A1 | 2/2014 | Kim et al. |
| 2014/0080216 A1 | 3/2014 | Cost et al. |
| 2014/0090112 A1 | 3/2014 | Cogan et al. |
| 2014/0090113 A1 | 3/2014 | Cogan et al. |
| 2014/0090116 A1 | 3/2014 | Ainley et al. |
| 2014/0112896 A1 | 4/2014 | Rebar et al. |
| 2014/0123330 A1 | 5/2014 | Carlson et al. |
| 2014/0127752 A1 | 5/2014 | Zhou et al. |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0227787 A1 | 8/2014 | Zhang et al. |
| 2014/0234972 A1 | 8/2014 | Zhang et al. |
| 2014/0235933 A1 | 8/2014 | Lee et al. |
| 2014/0242664 A1 | 8/2014 | Zhang et al. |
| 2014/0242699 A1 | 8/2014 | Zhang et al. |
| 2014/0242700 A1 | 8/2014 | Zhang et al. |
| 2014/0242702 A1 | 8/2014 | Chen et al. |
| 2014/0248702 A1 | 9/2014 | Zhang et al. |
| 2014/0256046 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273231 A1 | 9/2014 | Zhang et al. |
| 2014/0273232 A1 | 9/2014 | Zhang et al. |
| 2014/0273233 A1 | 9/2014 | Chen et al. |
| 2014/0273234 A1 | 9/2014 | Zhang et al. |
| 2014/0273235 A1 | 9/2014 | Voytas et al. |
| 2014/0287938 A1 | 9/2014 | Zhang et al. |
| 2014/0294773 A1 | 10/2014 | Brouns et al. |
| 2014/0295556 A1 | 10/2014 | Joung et al. |
| 2014/0295557 A1 | 10/2014 | Joung et al. |
| 2014/0298547 A1 | 10/2014 | Sastry-Dent et al. |
| 2014/0304853 A1 | 10/2014 | Ainley et al. |
| 2014/0309487 A1 | 10/2014 | Lee et al. |
| 2014/0310828 A1 | 10/2014 | Lee et al. |
| 2014/0310830 A1 | 10/2014 | Zhang et al. |
| 2014/0335063 A1 | 11/2014 | Cannon et al. |
| 2014/0335620 A1 | 11/2014 | Zhang et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349405 A1 | 11/2014 | Sontheimer et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0357530 A1 | 12/2014 | Zhang et al. |
| 2014/0364333 A1 | 12/2014 | Wu et al. |
| 2014/0377868 A1 | 12/2014 | Joung et al. |
| 2015/0020223 A1 | 1/2015 | Zhang et al. |
| 2015/0024499 A1 | 1/2015 | Brouns et al. |
| 2015/0031089 A1 | 1/2015 | Lindstrom |
| 2015/0031134 A1 | 1/2015 | Zhang et al. |
| 2015/0045546 A1* | 2/2015 | Siksnys ............ C12N 9/22 536/23.1 |
| 2015/0050699 A1 | 2/2015 | Siksnys et al. |
| 2015/0071889 A1 | 3/2015 | Musunuru et al. |
| 2015/0079681 A1 | 3/2015 | Zhang |
| 2015/0128300 A1 | 5/2015 | Warming et al. |
| 2015/0128307 A1 | 5/2015 | Sastry-Dent et al. |
| 2015/0128308 A1 | 5/2015 | Sastry-Dent et al. |
| 2015/0128309 A1 | 5/2015 | Sastry-Dent et al. |
| 2015/0159174 A1 | 6/2015 | Frendewey et al. |
| 2015/0159175 A1 | 6/2015 | Frendewey et al. |
| 2015/0167000 A1 | 6/2015 | Voytas et al. |
| 2015/0184139 A1 | 7/2015 | Zhang et al. |
| 2015/0203872 A1 | 7/2015 | Zhang |
| 2015/0211058 A1 | 7/2015 | Carstens |
| 2015/0225734 A1 | 8/2015 | Voytas et al. |
| 2015/0225801 A1 | 8/2015 | Cai et al. |
| 2015/0232833 A1 | 8/2015 | Mali et al. |
| 2015/0232881 A1 | 8/2015 | Glucksmann et al. |
| 2015/0232882 A1 | 8/2015 | Dahlman et al. |
| 2015/0240261 A1 | 8/2015 | Siksnys et al. |
| 2015/0240263 A1 | 8/2015 | Holmes et al. |
| 2015/0247150 A1 | 9/2015 | Zhang et al. |
| 2015/0259684 A1 | 9/2015 | Church et al. |
| 2015/0259704 A1 | 9/2015 | Church et al. |
| 2015/0267176 A1 | 9/2015 | Joung et al. |
| 2015/0267205 A1 | 9/2015 | Froelich et al. |
| 2015/0283265 A1 | 10/2015 | Peyman |
| 2015/0284727 A1 | 10/2015 | Kim et al. |
| 2015/0291961 A1 | 10/2015 | Siksnys et al. |
| 2015/0291965 A1 | 10/2015 | Zhang et al. |
| 2015/0291966 A1 | 10/2015 | Zhang et al. |

(56) References Cited

U.S. PATENT DOCUMENTS

| | | |
|---|---|---|
| 2015/0291969 A1 | 10/2015 | Nair et al. |
| 2015/0344912 A1 | 12/2015 | Kim et al. |
| 2016/0298134 A1 | 10/2016 | Chen et al. |

FOREIGN PATENT DOCUMENTS

| | | |
|---|---|---|
| CN | 103343120 A | 10/2013 |
| EP | 2 341 149 | 7/2011 |
| EP | 2 489 275 | 8/2012 |
| EP | 2674501 | 12/2013 |
| EP | 2764103 A2 | 12/2013 |
| EP | 2784162 B1 | 4/2015 |
| WO | WO 1988/08450 | 11/1988 |
| WO | WO 2002/034771 | 5/2002 |
| WO | WO 2007/025097 A3 | 3/2007 |
| WO | WO 2007/136815 | 11/2007 |
| WO | WO 2008/108989 A3 | 9/2008 |
| WO | WO 2010/021692 | 2/2010 |
| WO | WO 2010/054108 | 5/2010 |
| WO | WO 2010/075424 | 7/2010 |
| WO | WO 2010/076057 A1 | 7/2010 |
| WO | WO 2010/117464 | 10/2010 |
| WO | WO 2010/125471 | 11/2010 |
| WO | WO 2011/011767 | 1/2011 |
| WO | WO 2011/072246 A2 | 6/2011 |
| WO | WO 2011/146121 | 11/2011 |
| WO | WO 2011/156430 | 12/2011 |
| WO | WO 2012/012738 | 1/2012 |
| WO | WO 2012/164565 | 12/2012 |
| WO | WO 2013/044008 | 3/2013 |
| WO | WO 2013/082519 A2 | 6/2013 |
| WO | WO 2013/098244 | 7/2013 |
| WO | WO 2013/126794 | 8/2013 |
| WO | WO 2013/130824 | 9/2013 |
| WO | WO 2013/141680 A1 | 9/2013 |
| WO | WO 2013/142578 A1 | 9/2013 |
| WO | WO 2013/155572 | 10/2013 |
| WO | WO 2013/160230 | 10/2013 |
| WO | WO 2013/169398 | 11/2013 |
| WO | WO 2013/169802 | 11/2013 |
| WO | WO 2013/176772 | 11/2013 |
| WO | WO 2013/181440 | 12/2013 |
| WO | WO 2013/186754 | 12/2013 |
| WO | WO 2013/188522 | 12/2013 |
| WO | WO 2013/188638 | 12/2013 |
| WO | WO 2013/192278 | 12/2013 |
| WO | WO 2014/011237 | 1/2014 |
| WO | WO 2014/011901 | 1/2014 |
| WO | WO 2014/018423 A2 | 1/2014 |
| WO | WO 2014/022702 A2 | 2/2014 |
| WO | WO 2014/039684 | 3/2014 |
| WO | WO 2014/039692 | 3/2014 |
| WO | WO 2014/039702 | 3/2014 |
| WO | WO 2014/039872 | 3/2014 |
| WO | WO2014059255 | 4/2014 |
| WO | WO 2014/065596 | 5/2014 |
| WO | WO 2014/071006 | 5/2014 |
| WO | WO 2014/089290 | 6/2014 |
| WO | WO 2014-093479 | 6/2014 |
| WO | WO 2014/093595 A1 | 6/2014 |
| WO | WO 2014/093622 A3 | 6/2014 |
| WO | WO 2014/093635 A2 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/099744 | 6/2014 |
| WO | WO 2014/099750 | 6/2014 |
| WO | WO 2014/104878 | 7/2014 |
| WO | WO 2014/113493 | 7/2014 |
| WO | WO 2014/127287 A1 | 8/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |

OTHER PUBLICATIONS

Jinek et al. (2012) A Programmable Dual-RNA—Guided DNA Endonuclease in Adaptive Bacterial Immunity. Science, 337:816-821 and supplementary materials, published online Jun. 28, 2012.*

CCK74173.1 (CRISPR-associated protein Cas9/Csn1 , NCBI Reference Accession, priority to Sep. 7, 2012).*

Wu et al. (2009) Effect of Genome Size on AAV Vector Packaging. Molecular Therapy, 18(1):80-86.*

Sapranauskas et al. (2011) The *Streptococcus thermophilus* CRISPR/Cas system provides immunity in *Escherichia coli*. Nucleic Acids Research, 39(21):9275-9282, and supplementary materials, published online Aug. 3, 2011.*

Deltcheva et al. (2011) CRISPR RNA maturation by trans-encoded small RNA and host factor RNase III. Nature, 471:602-607 and supplementary data.*

Applicant-submitted Appendices A-K in support of Suggestion of Interference, filed Apr. 13, 2015 in parent U.S. Appl. No. 13/842,859, 623 pages.*

Raymond et al. (2007) High-Efficiency FLP and PhiC31 Site-Specific Recombination in Mammalian Cells. PLoS One, 1:e162, pp. 1-4.*

Carroll, D. (2011) Genome Engineering With Zinc-Finger Nucleases. Genetics, 188:773-782.*

Aguilera; et al., "Systemic in vivo distribution of activatable cell penetrating peptides is superior to cell penetrating peptides", Integr. Biol. (Camb.), (Jun. 2009), 1(5-6):371-381.

Cong; et al., "Multiplex Genome Engineering Using CRISPR/Cas Systems", Sciencexpress Reports (Jan. 2013), 1:1-7.

Deltcheva; et al., "CRISPR RNA maturation by trans-encoded small RNA and host factor RNase III.", Nature (Mar. 2011), 471(7340):602-607.

Drag; et al., "DeSUMOylating enzymes—SENPs.", IUBMB Life. (Nov. 2008), 60(11):734-742.

Gasiunas; et al., "Cas9-crRNA ribonucleoprotein complex mediates specific DNA cleavage for adaptive immunity in bacteria.", PNAS (Sep. 2012), 109(39):e2579-86.

Jinek; et al., "A programmable dual-RNA-guided DNA endonuclease in adaptive bacterial immunity.", Science (Aug. 2012), 337(6096):816-21.

Makarova; et al., "Evolution and classification of the CRISPR-Cas systems.", Nature Reviews Microbiology (May 2011), AOP 1-11.

Mali et al., "RNA-Guided Human Genome Engineering via Cas9", Sciencexpress (Jan. 2013), 1:1-5.

Olson et al., "In vivo characterization of activatable cell penetrating peptides for targeting protease activity in cancer", Integr. Biol (May 2009), 1(5-6):382-393.

Sapranauskas et al., "The *Streptococcus thermophilus* CRISPR/Cas system provides immunity in *Escherichia coli*", Nucleic Acids Research (Aug. 2011), 39(21):9275-9282.

Tanaka et al., "Conformational variations in an infectious protein determine prion strain differences", Nature (Mar. 2004), 428(6980):323-328.

Wiedenheft; et al., "RNA-guided genetic silencing systems in bacteria and archaea", Nature (Feb. 2012), 482(7385):331-8.

Hale, et al. "RNA-guided RNA cleavage by a CRISPR RNA-Cas protein complex.", Cell, 2009, vol. 139, No. 5, pp. 945-956.

Sashital, et al., "Mechanism of foreign DNA selection in a bacterial adaptive immune system", Molecular Cell, 2012, vol. 46, No. 5, pp. 606-615.

International Search Report and Written Opinion dated Jul. 26, 2013 for International Application No. PCT/US2013/032589, International Filing Date: Mar. 15, 2013, 19 pgs.

Chylinski; et al., "The tracrRNA and Cas9 families of type II CRISPR-Cas immunity systems.", RNA Biology (May 2013), 10(5):726-737.

(56) References Cited

OTHER PUBLICATIONS

Qi; et al., "Repurposing CRISPR as an RNA-guided platform for sequence-specific control of gene expression.", Cell (Feb. 2013), 152(5):1173-1183.
Jiang; et al., "RNA-guided editing of bacterial genomes using CRISPR-Cas systems.", Nat Biotechnol (Mar. 2013), 31(3):233-9.
Cho; et al., "Targeted genome engineering in human cells with the Cas9 RNA-guided endonuclease.", Nature Biotechnol. (Mar. 2013), 31:230-2.
Jinek; et al., "RNA-programmed genome editing in human cells.", eLife. (Jan. 2013), 2:e00471.
U.S. Appl. No. 14/054,414, filed Oct. 15, 2013, USPTO Office Action dated Dec. 5, 2013.
U.S. Appl. No. 14/054,414, filed Oct. 15, 2013, Response to USPTO Office Action filed on Dec. 17, 2013.
U.S. Appl. No. 14/054,414, filed Oct. 15, 2013, USPTO Office Action dated Jan. 17, 2014.
U.S. Appl. No. 14/054,414, filed Oct. 15, 2013, Response to USPTO Office Action filed Jan. 30, 2014.
U.S. Appl. No. 14/054,414, filed Oct. 15, 2013, Notice of Allowance dated Feb. 20, 2014.
Barrangou, et al., "RNA-mediated programmable DNA cleavage.", Nat Biotechnol. (Sep. 2012), 30(9):836-838.
Cong; et al., "Supplementary Materials to: Multiplex Genome Engineering Using CRISPR/Cas Systems"; Science (2013) vol. 339, No. 6121, pp. 819-823.
Gaj; et al., "ZFN, TALEN, and CRISPR/Cas-based methods for genome engineering.", Cell (Jul. 2013), 3(7):397-405.
Gilbert; et al., "CRISPR-mediated modular RNA-guided regulation of transcription in eukaryotes.", Cell (Jul. 2013), 154(2):442-451.
Haft; et al., "A guild of 45 CRISPR-associated (Cas) protein families and multiple CRISPR/Cas subtypes exist in prokaryotic genomes.", PLoS Computational Biology (Nov. 2005), 1(6):477-483.
Hockmeyer; et al., "Genetic engineering of human ES and iPS cells using TALE nucleases", Nature Biotechnology (Jul. 2011), 29(8):731-734.
Hwang; et al., "Efficient genome editing in zebrafish using a CRISPR-Cas system.", Nature Biotechnology (Mar. 2013), 31(3):227-229.
Jansen; et al., "Identification of genes that are associated with DNA repeats in prokaryotes", Molecular Microbiology (Mar. 2002), 43(6):1565-1575.
Kennedy; et al., "Rapid blue-light induction of protein interactions in living cells.", Nature Methods (Dec. 2010), 7(12):973-975.
Li; et al., "High-efficiency TALEN-based gene editing produces disease-resistant rice.", Nat Biotechnol. (May 2012), 30(5):390-392.
Ma; et al., "A guide RNA sequence design platform for the CRISPR/Cas9 system for model organism genomes.", Biomed Research International (2013), vol. 31, No. 3, pp. 822-824.
Marraffini; et al., "Self versus non-self discrimination during CRISPR RNA-directed immunity", Nature (Jan. 2010), 463(7280):568-571.
Mojica; et al., "Short motif sequences determine the targets of the prokaryotic CRISPR defence system (Supplementary Data Fig. S1)", Microbiology (Mar. 2009), 155(3):733-740.
Moore; et al., "Improved somatic mutagenesis in zebrafish using transcription activator-like effector nucleases (TALENs).", PLoS One, (2012), 7(5): pp. 1-9.
Sanjana; et al., "A transcription activator-like effector (TALE) toolbox for genome engineering.", Nat Protocols (Jan. 2012), 7(1):171-192.
Shalem; et al., "Genome-scale CRISPR-Cas9 knockout screening in human cells.", Science (Jan. 2014), 343(6166):84-87.
Sun; et al., "Optimized TAL effector nucleases (TALENs) for use in treatment of sickle cell disease.", Molecular Biosystems (Apr. 2012), 8(4):1255-1263.
Terns; et al., "CRISPR-based adaptive immune systems.", Current Opinion in Microbiology. (Jun. 2011), 14(3):321-327.
Wang; et al., "Spatiotemporal control of gene expression by a light-switchable transgene system.", Nature Methods. (Feb. 2012), 9(3):266-269.
Wang; et al., "One-step generation of mice carrying mutations in multiple genes by CRISPR/Cas-mediated genome engineering.", Cell (May. 2013), 153(4):910-918.
GenBank Accession No. AAL81255, Feb. 25, 2002, "hypothetical protein PF1131 [Pyrococcus furiosus DSM 3638]".
Al-Attar et al., "Clustered Regularly Interspaced Short Palindromic Repeats (CRISPRs): The Hallmark of an Ingenious Antiviral Defense Mechanism in Prokaryotes", Biol. Chem., 2011, vol. 392, Issue 4, pp. 277-289.
Anguela, et al., "In Vivo Genome Editing of Liver Albumin for Therapeutic Gene Expression: Rescue of Hemophilic Mice Via Integration of Factor 9", 54$^{th}$ ASH Annual Meeting and Exposition, Dec. 10, 2012, Atlanta, Georgia.
Barranger, et al., "Gene Transfer Approaches to the Lysosomal Storage Disorders", Neurochemical Research, 1999, vol. 24, No. 4, pp. 601-615.
Beloglazova, et al., "A Novel Family of Sequence-specific Endoribonucleases Associated with the Clustered Regularly Interspaced Short palindromic Repeats", Journal of Biological Chemistry, 2008, vol. 283, No. 39, pp. 20361-20371.
Bolotin, et al., "Clustered Regularly Interspaced Short Palindrome Repeats (CRISPRs) Have Spacers of Extrachromosomal Origin", Microbiology, Society for General Microbiology, 2005, vol. 151, No. Pt 8, pp. 2551-2561.
Bolotin, et al., "Complete Sequence and Comparative Genome Analysis of the Dairy bacterium *Streptococcus thermophiles*", Nature Biotechnology, 2004, vol. 22, No. 12, pp. 1554-1558.
Barras, "Right on Target: New Era of Fast Genetic Engineering", New Scientist, Jan. 2014, vol. 2953.
Barrangou, et al., "CRISPR Provides Acquired Resistance Against Viruses in Prokaryotes", Science, 2007, vol. 313, pp. 1709-1712.
Beres et al. "Genome sequence of a serotype M3 strain of group A *Streptococcus*: Phage-encoded toxins, the high-virulence phenotype, and clone emergence" Proc. Natl. Acad. Sci. USA, 2002, vol. 99, No. 15, pp. 10078-11083.
Biffi, et al., "Metachromatic Leukodystrophy: an Overview of Current and Prospective Treatments" Bone Marrow Transplantation, 2008, vol. 42, pp. S2-S6.
Biffi, "Genetically-Modified Hematopoeitic Stem Cells and Their Progeny for Widespread and Efficient Protein Delivery to Diseased Sties: the Case of Lysosomal Storage Disorders" Current Gene Therapy, 2012, vol. 12, pp. 38-388.
Carroll, "A CRISPR Approach to Gene Targeting.", Mol. Ther., 2012, vol. 20, pp. 1658-1660.
Carte et al., "Cas6 is an Endoribonuclease that Generates Guide RNAs for Invader Defense in Prokaryotes", Genes & Development, 2008, vol. 22, No. 24, pp. 3489-3496.
Cermak, et al., "Efficient Design and Assembly of Custom TALEN and other TAL Effector-based Constructs for DNA Targeting", Nucleic Acid Research, 2011, vol. 39, No. 12, pp. 1-11.
Charpentier, Abstracts of the Interscience Conference on Antimicrobial Agents and Chemotherapy, 2012, 52, 1785.
Cong et al., "Comprehensive Interrogation of Natural TALE DNA-Binding Modules and Transcriptional Repressor Domains", Nature Communications, 2012, vol. 3, pp. 968-1.
Courtin, et al., "Interactions Between Microorganisms in a Simple Ecosystem: Yogurt Bacteria as a Study Model", LAIT, 2004, vol. 84, pp. 125-134.
Cradick, et al., "ZFN-Site Searches Genomes for Zinc Finger Nuclease Target Sites and Off-Targets", BMC Bioinformatics, 2011, vol. 12, pp. 1-10.
Dagnino, et al., "Molecular Diagnosis of Analbuminemia: A New Case Caused by a Nonsense Mutation on the Albumin Gene", International Journal of Molecular Sciences, 2011, vol. 12, No. 12, pp. 7314-7322.
Editas Press Release, "Editas Medicine Created to Discover and Develop Novel Class of Genome Editing Therapeutics", Nov. 25, 2013.

(56) References Cited

OTHER PUBLICATIONS

Ferretti et al. "Complete genome sequence of an M1 strain of *Streptococcus pyogenes*" Proc. Natl. Acad. Sci. USA, 2001, vol. 98, No. 8, pp. 4658-4663.
Fu et al., "Improving CRISPR-Cas Nuclease Specificity Using Truncated Guide RNAs," Nature Biotechnology, 2014, vol. 32, No. 3, pp. 279-284.
Garneau et al., "The CRISPR/Cas Bacterial Immune System Cleaves Bacteriophage and Plasmid DNA", Nature, Nov. 2010, vol. 468, pp. 67-71.
Gentner et al., "Identification of Hematopoietic Stem Cell-Specific miRNAs Enables Gene Therapy of Globoid Cell Leukodystophy" Science Translational Medicine, 2010, vol. 2, No. 58, pp. 66-76.
Gritti, "Gene Therapy for Lysosomal Storage Disorders", Expert Opinion on Biological Therapy, 2011, vol. 11, No. 9, pp. 1153-1167.
Grabowski, et al., "Phenotype, Diagnosis, and Treatment of Gaucher's Disease", The Lancet, 2008, vol. 372, No. 9645, pp. 1263-1271.
Gray, et al., Maturase [Neosartorya fischeri] GenBank Accession No. AAX39426, May 19, 2005.
Gupta, et al., "Zinc Finger Protein-dependent and independent Contributions to the in vivo Off-target Activity of Zinc Finger Nucleases", Nucleic Acids Research, 2011, vol. 39, No. 1, pp. 381-392.
Hale, et al., "Prokaryotic Silencing (psi) RNAs in Pyrococcus furiosus", RNA, 2008, vol. 14, pp. 2572-2579.
Hale et al., "Essential Features and Rational Design of CRISPR RNAs that Function with the Cas RAMP Module Complex to Cleave RNAs", Molecular Cell, 2012, vol. 45, No. 3, pp. 292-302.
Hatoum-Aslan, et al., "Mature Clustered, Regularly Interspaced, Short Palindromic Repeats RNA (crRNA) Length is Measured by a Ruler Mechanism Anchored at the Precursor Processing Site", PNAS, 2011, vol. 108, No. 52, pp. 21218-21222.
Hockmeyer, et al., "Efficient Targeting of Expressed and Silent Genes in Human ESCs and iPSCs using Zinc-finger Nucleases", Nature Biotechnology, 2009, vol. 27, No. 9, pp. 851-857.
Hofling, et al., "Human CD34+ Hematopoietic Progenitor Cell-Directed Lentiviral-Mediated Gene Therapy in a Xenotransplantation Model of Lysosomal Storage Disease", Molecular Therapy, 2004, vol. 9. No, 6. pp. 856-865.
Hsu et al., "DNA targeting specificity of RNA-guided Cas9 nucleases", Nature Biotechnology, 2013, vol. 31, No. 9, pp. 827-834.
Ishino et al., "Nucleotide Sequences of the lap Gene, Responsible for Alkaline Phosphates Isozyme Conversion in *Escherichia coli*, and Identification of the Gene Product," J. Bacteriology, 1987, vol. 169, No. 12, pp. 5429-5433.
Jacoby, et al., "Expanding LAGLIDADG Endonuclease Scaffold Diversity by Rapidly Surveying Evolutionary Sequence Space", Nucleic Acids Research, 2012, vol. 40, No. 11, pp. 4954-4964.
Jacoby, et al., "Chain A, Expanding LAGLIDADG Endonuclease Scaffold Diversity by Rapidly Surveying Evolutionary Sequence Space", GenBank Record Accession No. 3UVF_A, Oct. 10, 2012.
Jacoby, et al., TPA_exp: LAGLIDADG Endonuclease, partial (mitochondrion) [Trichoderma reesei], GenBank Accession No. DAA35182, Jun. 30, 2012.
Leimig, et al., "Functional Amelioration of Murine Galactosialidosis by Genetically Modified Bone Marrow Hematopoietic Progenitor Cells", Blood, 2002, vol. 99, No. 9, pp. 3169-3178.
Lintner, et al., "Structural and Functional Characterization of an Archaeal Clustered Regularly Interspaced Short Palindromic Repeatmar (CRISPR)-associated Complex for Antiviral Defense (CASCADE)", Journal of Biological Chemistry, 2011, vol. 286, No. 24, pp. 21643-21656.
Luo et al., "Highly parallel identification of essential genes in cancer cells" Proceedings of the National Academy of Sciences, 2008,vol. 105, No. 51, pp. 20380-20385.
Makarova, et al., "Unification of Cas Protein Families and a Simple Scenario for the Origin and Evolution of CRISPR-Cas Systems", Biology Direct, 2011, vol. 6, No. 1, pp. 1-27.
Malanowska, et al., "CTnDOT Integrase Performs Ordered Homology-Dependent and Homology-independent Strand Exchanges", Nucleic Acids Research, 2007, vol. 35, No. 17, pp. 5861-5873.
Mali et al., "Supplementary Materials for RNA-Guided Human Genome Engineering via Cas9", Science, 2013, pp. 10-11.
Marraffini et al., "CRISPR Interference Limits Horizontal Gene Transfer in Staphylococci by Targeting DNA", Science, 2008, vol. 322, No. 5909, pp. 1843-1845.
Mittelman, et al., "Zinc-finger Directed Double-strand Breaks with CAG Repeat Tracts Promote Repeat Instability in Human Cells", Proc. Natl Acad. Sci. USA, 2009, vol. 106, No. 24, pp. 9607-9612.
Mojica et al., "Long Stretches of Short Tandem Repeats are Present in the Largest Replicons of the Archaea Haloferax mediterranei and Haloferax volcanii and Could be Involved in Replicon Partitioning," Mol. Microbiology, 1995, vol. 17, No. 1, pp. 85-93.
Mojica, et al., "Intervening Sequences of Regularly Spaced Prokaryotic Repeats Derive from Foreign Genetic Elements", Journal of Molecular Evolution, 2005, vol. 60, No. 2, pp. 174-182.
Mojica et al., "Short Motif Sequences Determine the Targets of the Prokaryotic CRISPR Defence System", Microbiology, 2009, vol. 155, No. 3, pp. 733-740.
Moscou, et al., "A Simple Cipher Governs DNA Recognition by TAL Effectors", Science, 2009, vol. 326, No. 5959, p. 1501.
Muzykantov, "Drug Delivery by Red Blood Cells: Vascular Carriers Designed by Mother Nature", Expert Opinion on Drug Delivery, 2010, vol. 7, No. 4, pp. 403-427.
Orlando, et al., "Zinc-Finger Nuclease-driven Targeted Integration into Mammalian Genomes Using Donors with Limited Chromosomal Homology", Nucleic Acid Research, 2010, vol. 38, No. 15, pp. 1-15.
Papapetrou, et al., "Genomic Safe Harbors Permit High [beta]-globin Transgene Expression in thalassemia Induced Pluripotent Stem Cells", Nature Biotechnology, 2011, vol. 29, No. 1, pp. 73-78.
Pattanayak, et al., "Revealing Off-target Cleavage Specificities of Zinc-finger Nucleases by in Vitro Selection", Nature Methods, 2011, vol. 8, No. 9, pp. 765-770.
Pennisi, "The CRISPR Craze", Science, 2013, vol. 341, pp. 833-836.
Povirk, et al., "Role of Braca 1 in Nonhomologous DNA End Joining", U.S. Army Medical Research and Material Command, Award No. DAMD 17-03-01-0620, Sep. 2004, pp. 1-11.
Ramsubir, et al., "In vivo Delivery of Human Acid Ceramidase via Cord Blood Transplantation and Direct Injection of Lentivirus as Novel Treatment Approaches for Farber Disease", Molecular genetics and Metabolism, 2008, vol. 95, No. 3, pp. 133-141.
Rho, et al. "Diverse CRISPRs Evolving in Human Microbiomes", PLoS Genetics, 2012, vol. 8, No. 6, pp. 1-12.
Perez-Rodriguez, et al., "Envelope Stress is a Trigger of CRISPR RNA-mediated DNA Silencing in *Escherichia coli*", Molecular Microbiology, 2011, vol. 79, No. 3, pp. 584-599.
Sampson, et al., "A CRISPR/Cas System Mediates Bacterial Innate Immune Evasion and Virulence", Nature, 2013, vol. 497, No. 7448, pp. 254-257.
Sims et al., "High-throughput RNA interference screening using pooled shRNA libraries and next generation sequencing", Genome Biology, 2011, vol. 12, No. 10, p. R104.
Sontheimer et al., "Project 7: Establishing RNA-Directed DNA Targeting in Eukaryotic Cells; Project dates: Nov. 16, 2011 to Dec. 31, 2012" (Feb. 4, 2012).
Sorek et al., "CRISPR-Mediated Adaptive Immune Systems in Bacteria and Archaea", Ann. Rev. Biochem., 2013, vol. 82, pp. 237-266.
Sorek, et al., "CRISPR—a Widespread System that Provides Acquired Resistance Against Phages in Bacteria and Archaea", Nature Reviews Microbiology, 2008, vol. 6, No. 3, pp. 181-186.
Stern, et al., "Self-Targeting by CRISPR: Gene Regulation of Autoimmunity", Trends in Genetics, 2010, vol. 26, No. 8, pp. 335-340.
Tan, et al., "Precision Editing of Large Animal Genomes", Advances in Genetics, 2012, vol. 80, pp. 37-97.

(56) References Cited

OTHER PUBLICATIONS

Terns et al. "The CRISPR-Cas system: small RNA-guided invader small RNA-guided invader silencing in prokaryotes" *The FASEB J.* 2012, vol. 26, Abstract 353.3.
Urnov, et al., "Highly Efficient Endogenous Human Gene Correction Using Designed Zinc-Finger Nucleases", Nature: International Weekly Journal of Science, 2005, vol. 435, No. 7042, pp. 646-651.
Van Til, et al., "Lentiviral Gene Therapy of Murine Hematopoietic Stem Cells Ameliorates the Pompe Disease Phenotype",Blood, 2010, vol. 11, No. 26, pp. 5329-5337.
Wang, , et al., "Reprogramming Erythroid Cells for Lysosomal Enzyme Production Leads to Visceral and CNS Cross-correction in Mice with Hurler Syndrome", PNAS, 2009, vol. 106, No. 47, pp. 19958-19963.
Wang, et al., "Genetic Correction of [beta]-thalassemia patient-specific iPS Cells and its Use in Improving Hemoglobin Production in Irradiated SCID Mice", Cell Research, 2012, vol. 22, No. 4, pp. 637-648.
Westra, et al., "Cascade-mediated Binding and Bending of Negatively Supercoiled DNA", RNA Biology, 2012, vol. 9, No. 9, pp. 1134-1138.
Wiedenheft et al., "Structures of the RNA-guided Surveillance Complex from a Bacterial Immune System", Nature, 2011, vol. 477, No. 7365, pp. 486-489.
Young, et al., "Long-Term Expression of the Human Glucocerebrosidase Gene in Vivo After Transplantation of Bone Marrow Derived Cells Transformed with a Lentivirus vector", Journal of Gene Medicine, 2005, vol. 7, No. 7, pp. 878-887.
Zhang et al., "cSSMD: assessing collective activity for addressing off-target effects in genome-scale RNA interference screens" Bioinformatics, 2011, vol. 27, No. 20, p. 2775-2781.
Zhou, et al., "Mouse Model for the Lysosomal Disorder Galactosialidosis and Correction of the Phenotype with Overexpressing Erythroid Precursor Cells", Genes and Development, 1995, vol. 9, No. 21, pp. 2623-2634.
Andreas; et al., "Enhanced efficiency through nuclear localization signal fusion on phase PhiC31-integrase: activity comparison with Cre and FLPe recombinase in mammalian cells.", Nucleic Acids Research (Jun. 2002), 30(11):2299-2306.
Boch; et al., "Xanthomonas AvrBs3 family-type III effectors: discovery and function.", Annu. Rev. Phytopathol. (2010) vol. 48, pp. 419-436.
Christian; et al., "Targeting DNA double-strand breaks with TAL effector nucleases.", Genetics (Oct. 2010), 186(2):757-761.
Dingwall; et al., "A polypeptide domain that specifies migration of nucleoplasmin into the nucleus.", Cell (Sep. 1982), 30(2):449-458.
Goldfarb; et al., "Synthetic peptides as nuclear localization signals.", Nature (Aug. 1986) vol. 322, pp. 641-644.
Gustafsson; et al., "Codon bias and heterologous protein expression.", Trends in Biotechnology (Jul. 2004), 22(7):346-353.
Nakamura; et al., "Codon usage tabulated from international DNA sequence databases: status for the year 2000.", Nucleic Acids Res. (Jan. 2000), 28(1):292.
Patterson; et al., "Codon optimization of bacterial luciferase (lux) for expression in mammalian cells.", J. Ind. Microbiol. Biotechnol. (Mar. 2005), 32(3):115-123.
Porteus; et al., "Gene targeting using zinc finger nucleases.", Nat. Biotechnol. (Aug. 2005), 23(8):967-973.
Rand; et al., "Argonaute2 cleaves the anti-guide strand of siRNA during RISC activation.", Cell (Nov. 2005), 123(4):621-629.
Rebar; et al., "Induction of angiogenesis in a mouse model using engineered transcription factors.", Nat. Med. (Dec. 2002), 8(12):1427-1432.
Schramm; et al., "Recruitment of RNA polymerase III to its target promoters.", Genes Dev. (Oct. 2002), 16(20):2593-2620.
Shen, et al.; "Generation of gene-modified mice via Cas9/RNA-mediated gene targeting"; Cell Research; vol. 23, pp. 720-723 (Apr. 2, 2013).
Tolia; et al., "Slicer and the argonautes.", Nat. Chem. Biol. (Jan. 2007), 3(1):36-43.
Urnov; et al., "Highly efficient endogenous human gene correction using designed zinc-finger nucleases.", Nature. (Jun. 2005), 435(7042):646-651.
Third Party Observations for Application No. EP20130824232, filed on Sep. 22, 2014, Title: "CRISPR-CAS Systems and Methods for Altering Expression of Gene Products", Applicant: Broad Institute Inc.
U.S. Appl. No. 14/183,471, filed Feb. 18, 2014, Notice of Allowance dated Sep. 12, 2014, 18 pages.
U.S. Appl. No. 14/222,930, filed Mar. 24, 2014, Notice of Allowance dated Aug. 12, 2014, 17 pages.
U.S. Appl. No. 14/258,458, filed Apr. 22, 2014, Notice of Allowance dated Aug. 8, 2014, 12 pages.
U.S. Appl. No. 14/293,674, filed Jun. 2, 2014, Notice of Allowance dated Sep. 25, 2014, 18 pages.
U.S. Appl. No. 14/290,575, filed May 29, 2014, Notice of Allowance dated Sep. 16, 2014.
U.S. Appl. No. 14/259,420, filed Apr. 23, 2014, Notice of Allowance dated Jul. 18, 2014.
Third Party Observations Submitted on Sep. 24, 2014, for International Patent Application No. PCT/US2013/032589, international filing date Mar. 15, 2013.
Third Party Observations submitted on Jul. 18, 2014 in WO 2013/142578.
Third Party Observations submitted on Jul. 18, 2014 in WO 2013/141680.
Communication Forwarding Declaration of Feng Zhang, filed in U.S. Appl. No. 14/226,274, dated Nov. 2014 Declaration of Feng Zhang.
Examination Report Response European Application No. 13824232.6 in the name of The Broad Institute Inc., filed at the European Patent Office Dec. 31, 2014 (Examination Report Response).
Lambowitz; et al., "Group II introns: mobile ribozymes that invade DNA.", Cold Spring Harb Perspect Biol. (Aug. 2011), 3(8):a003616.
Letter to European Patent Office European Application No. 13824232.6 in the name of The Broad Institute Inc., filed at the European Patent Office Jan. 5, 2015 (Examination Report Letter).
Raymond; et al., "High-efficiency FLP and PhiC31 site-specific recombination in mammalian cells.", PLoS One. (Jan. 2007), 2(1):e162.
Third Party Observations Against European Application No. 13793997.1 (EP2800811) corresponding to the present application filed at the European Patent Office Jan. 6, 2015 (TPO).
Bassett; et al., "Highly efficient targeted mutagenesis of *Drosophila* with the CRISPR/Cas9 system.", Cell Rep. (Jul. 2013), 4(1):220-8.
Briner; et al., "Guide RNA functional modules direct Cas9 activity and orthogonality.", Mol Cell. (Oct. 2014), 56(2):333-9.
Deveau; et al., "Phage response to CRISPR-encoded resistance in *Streptococcus thermophilus*.", J. Bacteriol. (Feb. 2008), 190(4):1390-400.
Esvelt; et al., "Orthogonal Cas9 proteins for RNA-guided gene regulation and editing.", Nat Methods (Nov. 2013), 10(11):1116-21.
Gratz; et al., "Genome engineering of *Drosophila* with the CRISPR RNA-guided Cas9 nuclease.", Genetics (Aug. 2013), 194(4):1029-35.
Jiang; et al., "Demonstration of CRISPR/Cas9/sgRNA-mediated targeted gene modification in *Arabidopsis*, tobacco, sorghum and rice.", Nucleic Acids Res. (Nov. 2013), 41(20):e188.
Lo; et al., "Precise and heritable genome editing in evolutionarily diverse nematodes using TALENs and CRISPR/Cas9 to engineer insertions and deletions.", Genetics (Oct. 2013), 195(2):331-48.
Mastroianni; et al., "Group II intron-based gene targeting reactions in eukaryotes.", PLoS One. (Sep. 2008), 3(9):e3121.
Nekrasov; et al., "Targeted mutagenesis in the model plant Nicotiana benthamiana using Cas9 RNA-guided endonuclease", Nat. Biotechnol. (Aug. 2013), 31(8):691-3.
Swarts; et al., "CRISPR interference directs strand specific spacer acquisition.", PLoS One. (2012), 7(4):e35888.
Upadhyay; et al., "RNA-guided genome editing for target gene mutations in wheat.", G3( Bethesda), (Dec. 2013), 3(12):2233-8.

(56) References Cited

OTHER PUBLICATIONS

Xie; et al., "RNA-guided genome editing in plants using a CRISPR-Cas system.", Mol. Plant (Nov. 2013), 6(6):1975-83.
Yosef; et al., "Proteins and DNA elements essential for the CRISPR adaptation process in *Escherichia coli*.", Nucleic Acids Res. (Jul. 2012), 40(12):5569-76.
Horvath; et al., "RNA-guided genome editing à la carte.", Cell Res. (Jun. 2013), 23(6):733-4.
Pandika; et al, "Jennifer Doudna, CRISPR Code Killer.", The Presidential Daily Brief (2014).
Sanders, "Cheap and easy technique to snip DNA could revolutionize gene therapy", UC Berkeley News Center (Jan. 2013).
Sanders, "New DNA-editing technology spawns bold UC initiative", UC Berkeley News Center (Mar. 2014).
Third Party Observations for Application No. EP20130793997, filed on Jan. 6, 2015, Title: "Methods and Compositions for RNA-Directed Target DNA Modification and for RNA-Directed Modulation of Transcription", Applicant: Univ California.
UC Berkeley, "The CRISPR Revolution.", Catalyst Magazine (Jul. 2014).
Van Der Oost, "Molecular biology. New tool for genome surgery.", Science (Feb. 2013), 339(6121):768-70.
Third Party Observations for Application No. EP13715080, filed on Oct. 27, 2014, Title:"CRISPR-Based Genome Modification and Regulation", Applicant: Vilnius University.
Reiss, B. et al., RecA protein stimulates homologous recombination in plants, Proc. Natl. Acad. Sci. U.S.A. 1996, 93:3094-3098 (Apr. 2, 1996).
Fischer-Fantuzzi, et al.; "Cell-Dependent Efficiency of Reiterated Nuclear Signals in a Mutant Simian Virus 40 Oncoprotein Targeted to the Nucleus"; 8(12) Mol. Cell. Biol. 5495-5503 (1988).
Planey et al., Inhibition of Glucocorticoid-induced Apoptosis in 697 Pre-B Lymphocytes by the Mineralocorticoid Receptor N-terminal Domain, 277(44) J. Biol. Chem. 42188-42196 (2002).
Dai et al., The Transcription Factors GATA4 and dHAND Physically Interact to Synergistically Activate Cardiac Gene Expression through a p300-dependent Mechanism, 277(27) J. Biol. Chem. 24390-24398 (2002).
Roth, Michael G.; 43 Methods in Cell Biology, Protein Expression in Animal Cells, Chapters 2, 3, 6, 9 (1994).
Boden et al., Efficient Gene Transfer of HIV-1-Specific Short Hairpin RNA into Human Lymphocytic Cells Using Recombinant Adena-associated Virus Vectors, 9(3) Mol. Ther. 396-402 (2004).
Tiscornia et al., "Development of Lentiviral Vectors Expressing siRNA", Gene Transfer: Delivery and Expression of DNA and RNA, Chapter 3 (2007).
Anderson et al., A simple method for the rapid generation of recombinant adenovirus vectors, 7 Gene Ther. 1034-1038 (2000).
Sato et al., Generation of Adeno-Associated Virus Vector Enabling Functional Expression of Oxytocin Receptor and Fluorescence Marker Genes Using the Human eIF4G Internal Ribosome Entry Site Element, 73(9) Biosci. Biotechnol. Biochem. 2145-2148 (2009).
Wang et al., Targeted gene addition to a predetermined site in the human genome using a ZFN-based nicking enzyme, 22 Gen. Res. 1316-1326 (2012).
National Center for Biotechnology Information; http://www.ncbi.nlm.nih.gov/protein/403411236?sat=16&satkey=13804560 (downloaded on Jan. 21, 2015).
Wu et al., Effect of Genome Size on AAV Vector Packaging, 18(1) Mol. Ther. 80-86 (2010).
Lieber, The Mechanism of Double-Strand DNA Break Repair by the Nonhomologous DNA End Joining Pathway, 79 Annu. Rev. Biochem. 181-211 (2010).
Ramirez et al., Engineered zinc finger nickases induce homology-directed repair with reduced mutagenic effects, 40(12) Nucl. Acids Res. 5560-5568 (2012).
Jensen et al., An update on targeted gene repair in mammalian cells: methods and mechanisms, 18 J. Biomed. Sci. 10 (2011).

Park et al., Regulation of Ribosomal S6 Kinase 2 by Mammalian Target of Rapamycin, 277(35) J. Biol. Chem. 31423-31429 (2002).
U.S. Appl. No. 61/736,527, filed Dec. 12, 2012 to F. Zhang et al. ("Zhang '527 Application").
Nucleotide Blast® search, https://blast.ncbi.nlm.nih.gov/Blast.cgi (downloaded on Mar. 24, 2015).
National Center for Biotechnology Information, http://www.ncbi.nlm.nih.gov/protein/Q03LF7.1 (downloaded on Mar. 24, 2015).
Blackburn et al., Synthesis of Oligonucleotides, Nucleic Acids in Chemistry and Biology, Chapter 4 (2006).
The Glen Report, Glen Research, Apr. 2007.
Brown, Types of RNA Molecule: Noncoding RNA, Introduction to Genetics: a Molecular Approach, Chapter 6 (2012).
Sauer, B., Functional Expression of the cre-lox Site-Specific Recombination System in the Yeast *Saccharomyces cerevisiae*, Mol. Cell. Biol. 1987; 7:2087-2096 (Jun. 1987).
Sauer, B. et al., Site-specific DNA recombination in mammalian cells by the Cre recombinase of bacteriophage P1, Proc. Natl. Acad. Sci. U.S.A. 1988, 85:5166-5170 (Jul. 1988).
Choulika, A. et al., Transfer of single gene-containing long terminal repeats into the genome of mammalian cells by a retroviral vector carrying the cre gene and the loxP site, J. Virol. 1996, 70: 1792-1798 (Mar. 1996).
Bergemann, J. et al., Excision of specific DNA-sequences from integrated retroviral vectors via site-specific recombination, Nucleic Acids Res. 1995, 23:4451-4456 (Nov. 11, 1995).
Nucleotide Blast® search of "Leader" sequence, https://blast.ncbi.nlm.nih.qov/Blast.cgi (downloaded on Sep. 25, 2015).
Nucleotide Blast® search of "spacer1" sequence, https://blast.ncbi.nlm.nih.gov/Blast.cgi (downloaded on Sep. 25, 2014).
Tsien, The Green Fluorescent Protein, 67 Annu. Rev. Biochem 509-44 (1998).
Garneau; et al., "The CRISPR/Cas bacterial immune system cleaves bacteriophage and plasmid DNA.", Nature (Nov. 4, 2010), 468(7320):67-71.
Barrangou; et al., "CRISPR provides acquired resistance against viruses in prokaryotes.", Science (Mar. 2007), 315(5819):1709-12.
Nucleotide Blast® search of "spacer1 & spacer2" sequence, https://blast.ncbi.nlm.nih.gov/Blast.cgi (downloaded on Mar. 10, 2015).
Cong; et al., "Multiplex Genome Engineering Using CRISPR/Cas Systems"; Science (2013) vol. 339, No. 6121, pp. 819-823.
Symington, Double-Strand Break End Resection and Repair Pathway Choice, 45 Annu. Rev. Genet. 247-71 (2011).
Ishino; et al., "Nucleotide sequence of the iap gene, responsible for alkaline phosphates isozyme conversion in *Escherichia coli*, and identification of the gene product.", J. Bacteriol. (Dec. 1987), 169(12):5429-5433.
Mojica et al., Biological significance of a family of regularly spaced repeats in the genomes of Archaea, Bacteria and mitochondria, 36(1) Mol. Microbiol. 244-246 (2000).
Bolotin; et al., "Clustered regularly interspaced short palindrome repeats (CRISPRs) have spacers of extrachromosomal origin.", Microbiology (Aug. 2005), 151(Pt 8):2551-61.
Mojica; et al., "Intervening sequences of regularly spaced prokaryotic repeats derive from foreign genetic elements.", J. Mol Evol (Feb. 2005), 60(2):174-182.
Pourcel et al., CRISPR elements in Yersinia pestis acquire new repeats by preferential uptake of bacteriophage DNA, and provide additional tools for evolutionary studies, 151 Microbiol. Read. Engl. 653-663 (2005).
Makarova et al., A putative RNA-interference-based immune system in prokaryotes: computational analysis of the predicted enzymatic machinery, functional analogies with eukaryotic RNAi, and hypothetical mechanisms of action, 1 (7) Biol. Direct. 1-26 (2006).
Makarova; et al., "Evolution and classification of the CRISPR-Cas systems.", 9(6) Nat. Rev. Microbiol. 467-477 (2011).
Brouns et al., Small CRISPR RNAs guide antiviral defense in prokaryotes, 321 Science 960-964 (2008).
Nam et al., Cas5d Protein Processes Pre-crRNA and Assembles into a Cascade-like Interference Complex in Subtype 1-C/Dvulg CRISPR-Cas System, 20 Structure 1574-1584 (2012).
Haurwitz et al., Sequence- and structure-specific RNA processing by a CRISPR endonuclease, 329 Science 1355-1358 (2010).

(56) References Cited

OTHER PUBLICATIONS

Hatoum-Aslan; et al., "Mature clustered, regularly interspaced, short palindromic repeats RNA (crRNA) length is measured by a ruler mechanism anchored at the precursor processing site.", Proc Natl Acad Sci USA (Dec. 2011), 108(52):21218-22.
Rouillon et al., Structure of the CRISPR Interference Complex CSM Reveals Key Similarities with Cascade, 52(1) Mol. Cell. 124-134 (2013).
Declaration Under 37 C.F.R. §§ 1.132 and 1.131, filed in U.S. Appl. No. 14/054,414 on Jan. 30, 2014 with Exhibit 7 ("Zhang Declaration" or "Zhang").
Mali et al., "RNA-Guided Human Genome Engineering via Cas9", 339 Science 823-826 (2013).
Hwang et al., Efficient In Vivo Genome Editing Using RNA-Guided Nucleases, 31 (3) Nature Biotech 227-229 (2013).
Smith et al., Generation of a Nicking Enzyme that Stimulates Site-Specific Gene Conversion from the I-anil LAGLIDADG Homing Endonuclease, 106(13) PNAS 5099-104 (2009).
Neumann et al., Gene transfer into mouse lyoma cells by electroporation in high electric fields, 1(7) EMBO Journal 841-845 (1982).
Gorman et al., High efficiency gene transfer into mammalian cells, B307 Phil. Trans. R. Sec. Land. 343-346 (1984).
Hashimoto et al., 21 Applied Microbiol. & Biotechnol. 336-39 (1985).
Fechheimer et al., Transfection of mammalian cells with plasmid DNA by scrape loading and sonication loading, 84 PNAS 8463-8467 (1987).
Behr et al., Efficient gene transfer into mammalian primary endocrine cells with lipopolyamine-coated DNA, 86 PNAS 6982-6986 (1989).
Sambrook, et al.; "Introducing Cloned Genes into Cultured Mammalian Cells", Molecular Cloning: A Laboratory Manual, Chapter 16 (2001).
Fieck et al., Modifications of the *E. coli* Lac repressor for expression in eukaryotic cells: effects of nuclear signal sequences on protein activity and nuclear accumulation, 29(7) Nucl. Acids Res. 1785-1791 (1992).
Chiu et al., Engineered GFP as a vital reporter in plants, 6(3) Curr. Biol. 325-330 (1996).
Foecking et al., Powerful and versatile enhancer-promoter unit for mammalian expression vectors, 45(1) Gene 101-105 (1986).
O'Hare et al., Transformation of mouse fibroblasts to methotrexate resistance by a recombinant plasmid expressing a prokaryotic dihydrofolate reductase, 78(3) PNAS 1527-1531 (1981).
Carroll, Genome Engineering With Zinc-Finger Nucleases, 188 Genetics 773-782 (2011).
Diagram depicting the DNA-Binding Domain and DNA-Cleaving Domains of two ZFNs, http://www.sigmaaldrich.com/life-science/zinc-finger-nuclease-technology/learning-center/what-is-zfn.html (downloaded on Feb. 3, 2015).
Davis et al., Zinc Finger Nucleases for Genome Editing, 30 Gen. Eng. & Biotech. News. 1-2 (2010).
Mussolino et al., A novel TALE nuclease scaffold enables high genome editing activity in combination with low toxicity, 39(21) Nucl. Acids Res. 9283-9293 (2011) ("Mussolino").
Diagram depicting the DNA-Binding Domains (an array of TAL effector subunits) and DNA-Cleaving Domains of two TALENs, http://www.systembio.com/services_tales (downloaded on Feb. 3, 2015).
Alberts; Molecular Biology of the Cell 38, 59 (1994).
Mercier et al., A Transcription Factor Cascade Involving Fep1 and the CCAAT-Binding Factor Php4 Regulated Gene Expression in Response to Iron Deficiency in the Fission Yeast Schizosaccharomyces pombe, 5 Eukaryotic Cell 1866-1881 (2006).
DiCarlo et al., Genome engineering in *Saccharomyces cerevisiae* using CRISPR-Cas systems, 41 (7) Nucl. Acids Res. 4336-4343 (2013).
Dykxhoorn et al., Killing the Messenger: Short RNAs That Silence Gene Expression, 4 Nature 457-467 (2003).
Sandy et al., Mammalian RNAi: a practical guide, 39 B10Technioues 215-224 (2005).
Carney et al., Induction of DNA Double-Strand Breaks by Electroporation of Restriction Enzymes into Mammalian Cells, 113 Methods in Mol. Biol. 465-471 (1999).
Morgan, W.F. et al., Inducible Expression and Cytogenetic Effects of the EcoRI Restriction Endonuclease in Chinese Hamster Ovary Cells, Mol. Cell. Biol. 1988, 8:4204-4211 (Oct. 1988).
Kim et al., Precision Genome Engineering with Programmable DNA-Nicking Enzymes, 22 Genome Res. 1327-33 (2012).
Zavitz et al., A TPase-deficient Mutants of the *Escherichia coli* DNA Replication Protein PriA are Capable of Catalyzing the Assembly of Active Primosomes, 267(10) Journal of Biological Chemistry 6933-6940 (1992).
Saito et al., Identification of four acidic amino acids that consistute the catalytic center of the RuvC Holliday junction resolvase, 92 PNAS 7470-7474 (1995).
Lombardo, A. et al., Gene editing in human stem cells using zinc finger nucleases and integrase-defective lentiviral vector delivery, Nat. Biotechnol. 2007, Nov. 2007; 25: 1298-1306 (Nov. 2007). (Published online Oct. 28, 2007).
Li, H. et al., In vivo genome editing restores haemostasis in a mouse model of haemophilia, Nature 2011; 475:217-221 (Jun. 26, 2011) doi: 10.1038/nature10177.
U.S. Appl. No. 14/403,475, filed Nov. 24, 2014, Jinek et al.
U.S. Appl. No. 14/685,502, filed Apr. 13, 2015, Doudna et al.
U.S. Appl. No. 14/685,504, filed Apr. 13, 2015, Doudna et al.
U.S. Appl. No. 14/685,513, filed Apr. 13, 2015, Doudna et al.
U.S. Appl. No. 14/685,514, filed Apr. 13, 2015, Doudna et al.
U.S. Appl. No. 14/685,516, filed Apr. 13, 2015, Doudna et al.
Examination Report of UK Patent App. No. GB1420270.9 dated Feb. 25, 2015.
Examination Report of UK Patent App. No. GB1420270.9 dated Jun. 11, 2015.
Third Party Observations for UK Application No. GB1420270.9 filed Jun. 30, 2015.
Letter from Formalities Examiner to Regents of California indicating priority details and inventor name for UK Application No. GB1420270.9 have been corrected (dated Jul. 16, 2015).
Publication GB 2518764 A8 UK Application GB showing correction priority details and inventor name for UK Application No. GB1420270.9 have been corrected (reprint to rectify errors introduced in the course of reproduction—Jul. 22, 2015).
Form PCT/IB/306 for PCT/US2013/032589 "Notification of the Recording of a Change" (dated Dec. 13, 2013).
PCT Request for PCT/US2013/032589 dated Mar. 15, 2013.
Request to Record Change of Applicant Under Rule 92bis in the International Application for PCT/US2013/032589 dated Dec. 9, 2013.
Request to correct an error in the Ipsum information displayed online for UK Patent App. No. GB1420270.9 dated Jul. 6, 2015.
Request to correct an error in the UKIPO information concerning inventorship, as displayed on Ipsum and the "A" publication, for UK Patent App. No. GB1420270.9 dated Jul. 10, 2015.
Letter from Publishing Section to Regents of California indicating that the front page of GB2518764 A has been republished to correct the priority details and inventor details at INID (30) and (72) (dated Jul. 21, 2015).
Form PCT/IB/306 for PCT/US2013/032589 "Notification of the Recording of a Change" (dated Oct. 15, 2014).
Third Party Observations Against European Application No. 13793997.1 (EP2800811) filed by the Broad Institute, Inc. on or about Jul. 24, 2015, and associated Communication Pursuant to Rule 114(2) (EPC) (dated Aug. 4, 2015) (109 pages).
Non-Final Office Action of U.S. Appl. No. 14/385,241 dated Jun. 18, 2015.
Response to Restriction Requirement of U.S. Appl. No. 14/385,241 filed Jun. 4, 2015.
Information Disclosure Statement for U.S. Appl. No. 14/104,990 filed May 10, 2015.
Applicant Interview Summary of U.S. Appl. No. 14/105,035 with a filing date of May 14, 2015.

(56) References Cited

OTHER PUBLICATIONS

Applicant Interview Summary dated May 14, 2015 in U.S. Appl. No. 14/104,990 with a filing date of May 14, 2015.
Examiner Interview Summary dated May 14, 2015 in U.S. Appl. No. 14/104,990 dated of Jun. 12, 2015.
Addgene Materials May 2015.
Addgene Materials Oct. 2014 including Addgene News 2013.
Purported Email from Emmanuelle Charpentier to Feng Zhang (Jan. 5, 2013) (Charpentier email).
Purported Email from Feng Zhang to Jennifer A. Doudna (Jan. 4, 2013) (Zhang email).
Purported Email from Jennifer A. Doudna to Feng Zhang (Jan. 4, 2013) (Doudna email).
University of California, Berkeley Tweet of May 6, 2015 and link.
Mewburn Ellis, "Publicising Inventions," available at: http://mewburn.com/resource/publicisinginventions (printed Jul. 29, 2015).
SUEPO Working Paper, A Quality Strategy for the EPO; available at: http://www.suepo.org/public/docs/2002/quality.pdf (2002).
Cockrell, NewsCenter, "Berkeley's Wikipedian-in-residence is a first" (Feb. 25, 2014).
*Arbitron, Inc.* v. *Kieft*, No. 09-CV-04013 PAC, 2010 WL 3239414, at *1 (S.D.N.Y. Aug. 13, 2010).
*Manning* v. *Paradis*, 296 F.3d 1098 (Fed. Cir. 2012).
*Huang* v. *California Institute of Technology*, 2004 WL 2296330 (C.D. Cal. Feb. 18, 2004).
*Rubin* v. *The General Hospital Corp.*, 2011-1439 (Fed. Cir. Mar. 28, 2013).
*Ultra-Precision Mfg. Ltd.* v. *Ford Motor Co.*, 2004 WL 3507671, *7, *11-12 (E.D. Mich. Mar. 30, 2004).
*Maxwell* v. *The Stanley Works*, 2006 WL 1967012, *5 (M.D. Tenn. Jul. 11, 2006).
Cotropia et al., Copying in Patent Law, N.C.L. Rev., vol. 87, p. 1421, Stanford Public Law Working Paper No. 1270160 (2009).
Barrangou, et al.; "CRISPR-Cas Systems; RNA-mediated Adaptive Immunity in Bacteria and Archaea"; ISBN 978-3-642-34657-6 (2013).
Chen et al., "Dynamic Imaging of Genomic Loci in Living Human Cells by an Optimized CRISPR/Cas System," Cell 155, 1479-1491, Dec. 19, 2013.
Chen et al., "Genome-wide CRISPR Screen in a Mouse Model of Tumor Growth and Metastasis," Cell 160, 1-15 (2015).
Enyeart, P.J., et al., Biotechnological applications of mobile group II introns and their reverse transcriptases: gene targeting, RNA-seq, and non-coding RNA analysis, Mobile DNA 2014, 5:2 (Jan. 13, 2014).
Grens, "Enzyme Improves CRISPR A smaller Cas9 protein enables in vivo genome engineering via viral vectors," The Scientist, Apr. 1, 2015, available at: http://www.the-scientist.com/?articles.view/articleNo/42580/title/Enzyme-Improves-CRISPR/.
Hou et al., "Efficient genome engineering in human pluripotent stem cells using Cas9 from Neisseria meningitides," PNAS 110(39): 15644-15649 (Sep. 24, 2013).
Hsu, et al.; "Development and Applications of CRISPR-Cas9 for Genome Engineering"; Cell. Jun. 5, 2014;157(6):1262-78. doi: 10.1016/j.cell.2014.05.010.
Konermann et al., "Genome-scale transcriptional activation by an engineered CRISPR-Cas9 complex," Nature 517:583-588 (2015).
Le Rhun, et al.; "Small RNAs in streptococci"; RNA Biology; 9:4, 414-426, DOI: 10.4161/rna.20104 (Apr. 2012).
Marraffini et al.; "CRISPR interference: RNA-directed adaptive immunity in bacteria and archaea"; Nat Rev Genet.; 11(3): 181-190. doi:10.1038/nrg2749 (Mar. 2010).
Meshorer and Misteli, Nature Reviews Molecular Cell Biology 7, 540-546 (Jul. 2006).
Nishimasu et al., "Crystal Structure of Cas9 in Complex with Guide RNA and Target DNA," Cell 156, 935-949 (2014).
Paddison et al. "Short hairpin RNAs (shRNAs) induce sequence-specific silencing in mammalian cells," Genes & Development 16:948-958 (2002).
Platt et al., "CRISPR-Cas9 Knockin Mice for Genome Editing and Cancer Modeling," Cell, 159(2):440-455 (2014).
Ran et al., "Double Nicking by RNA-Guided CRISPR Cas9 for Enhanced Genome Editing Specificity," Cell 154, 1380-1389 (Sep. 12, 2013).
Ran et al., "In vivo genome editing using *Staphylococcus aureus* Cas9," Nature 520, 186-191 (Apr. 9, 2015) doi: 10.1038/nature14299 (Published online Apr. 1, 2015).
Stolfi et al., "Tissue-specific genome editing in Ciona embryos by CRISPR/Cas9," Development (2014) 141, 4115-4120 doi:10.1242/dev. 114488.
Swiech et al., "In vivo interrogation of gene function in the mammalian brain using CRISPR-Cas9," Nature Biotechnology 33, 102-106 (2015).
Wu et al., "Genome-wide binding of the CRISPR endonuclease Cas9 in mammalian cells", Nat Biotechnol. 2014, 32(7):670-676, doi: 10.1038/nbt.2889 (published online Apr. 20, 2014).
Zetsche et al. "A split-Cas9 architecture for inducible genome editing and transcription modulation," Nature biotechnology, 33(2): 139-142 (2015).
Certified File History of U.S. Appl. No. 61/736,527, filed Dec. 12, 2012 (certification date of Dec. 25, 2013).
Second Examination Report in GB1420270.9 (4 pages) dated Aug. 17, 2015.
Anonymous Third Party Observations in GB1420270.9 dated Jul. 13, 2015 (18 pages) (available to the public on Aug. 14, 2015).
Extended European Search Report with Annex in EP13793997.1 (12 pages) dated Aug. 26, 2015.
Brouns, A Swiss Army Knife of Immunity, 337 Science 808-809 (Aug. 17, 2012).
Chang et al., Genome editing with RNA-guided Cas9 nuclease in Zebrafish embryos, 23 Cell Research 465-472 (2013).
Horvath et al., CRISPR/Cas, the Immune System of Bacteria and Archaea, 327 Science 167-170 (Jan. 8, 2010).
Horvath et al., Diversity, Activity, and Evolution of CRISPR Loci in *Streptococcus thermophilus*, 190(4) Journal of Bacteriology 1401-1412 Feb. 2008).
U.S. Appl. No. 61/734,256, filed Dec. 6, 2012, Fuqiang Chen.
U.S. Appl. No. 61/758,624, filed Jan. 30, 2013, Fuqiang Chen.
U.S. Appl. No. 61/761,046, filed Feb. 5, 2013, Scott Knight.
U.S. Appl. No. 61/794,422, filed Mar. 15, 2013, Scott Knight.
U.S. Appl. No. 61/735,876, filed Dec. 11, 2012, Blake A. Wiedenheft.
U.S. Appl. No. 61/799,531, filed Mar. 15, 2013, Blake A. Wiedenheft.
U.S. Appl. No. 61/738,355, filed Dec. 17, 2012, George M. Church.
U.S. Appl. No. 61/779,169, filed Mar. 13, 2013, Prashant Mali.
U.S. Appl. No. 61/613,373, filed Mar. 20, 2012.
U.S. Appl. No. 61/625,420, filed Apr. 17, 2012.
Information Disclosure Statement for U.S. Appl. No. 14/104,990, filed Sep. 4, 2015.
Federal Circuit decision in *Dow Chemical Co.* V. *Nova Chemicals Corp.* Appeal Nos. 2014-1431, 2014-1462 (Fed. Cir. Aug. 28, 2015) (*Dow* v. *Nova*).
Baker, Gene Editing at CRISPR Speed, 32(4) Nature Biotechnology 309-312 (Apr. 4, 2014).
Mukhopadyay, "On the Same Wavelength," ASBMBTODAY (Aug. 2014), available at http://www.asbmb.org/asbmbtoday/201408/Features/Doudna/(printed Sep. 14, 2015).
Connor, "Scientific split—the human genome breakthrough dividing former colleagues," The Independent, Friday Apr. 25, 2014, Available at http://www.independent.co.uk/news/science/scientific-split--the-human-genome-breakthrough-dividing-former-colleagues-9300456.html (printed Sep. 14, 2015).
Nishimasu et al., Crystal Structure of *Staphylococcus aureus* Cas9, 162(5) Cell, 1113-1126 (Aug. 27, 2015).
Third Party Observations Concerning EP Application No. 13793997.1, Sep. 4, 2015.
Information Disclosure Statement for U.S. Appl. No. 14/105,035, filed Sep. 10, 2015.
PowerPoint slide entitled "Development and Applications of CRISPR-Cas9 for Genome Editing" dated Sep. 9, 2015.
PowerPoint slide entitled "Interview Sep. 9, 2015."

(56) References Cited

OTHER PUBLICATIONS

Selected Claims of Applications Being Interviewed Sep. 9, 2015.
Bhaya et al. CRISPR/Cas Systems in Bacteria and Archaea Versatile Small RNAs for Adaptive Defense and Regulation, 45 Annual Review of Genetics 273-297 (2011).
Deveau et al., CRISPR/Cas and Its Role in Phage-Bacteria Interactions, 64 Annual Review of Microbiol. 475-493 (2010).
Office Action issued in U.S. Appl. No. 14/705,719, dated Sep. 2, 2015.
Preliminary Amendment filed in U.S. Appl. No. 14/683,443, dated Jun. 18, 2015.
UK Intellectual Property Office (UKIPO) Examination Report for GB1420270.9 dated Aug. 17, 2015.
Third Party Observations filed for GB1420270.9 on Jul. 13, 2015.
Preliminary Amendment filed in U.S. Appl. No. 14/681,510, dated Aug. 19, 2015.
Exhibit D, Interview Agenda for Sep. 9, 2015 Interview.
Exhibit E, Zhang/Broad U.S. Appl. No. 14/105,031 as Doudna U.S. Appl. Nos. 61/652,086 and 61/716,256 Fail to Teach or Suggest Claimed Invention.
Exhibit F, Zhang/Broad U.S. Appl. No. 14/105,035 as Doudna U.S. Appl. Nos. 61/652,086 and 61/716,256 Fail to Teach or Suggest Claimed Invention.
Exhibit G, Zhang/Broad U.S. Appl. No. 14/704,551 as Doudna U.S. Appl. Nos. 61/652,086 and 61/716,256 Fail to Teach or Suggest Claimed Invention.
Exhibit H, Zhang/Broad U.S. Appl. No. 14/497,627 as Doudna U.S. Appl. Nos. 61/652,086 and 61/716,256 Fail to Teach or Suggest Claimed Invention.
Exhibit I, Zhang/Broad U.S. Appl. No. 14/104,990 as Doudna U.S. Appl. Nos. 61/652,086 and 61/716,256 Fail to Teach or Suggest Claimed Invention.
Exhibit J, Minton, How Can Biochemical Reactions Within Cells Differ From Those in Test Tubes?, 119 Journal of Cell Science 2863-2869 (2006).
Exhibit K, Ellis, Macromolecular Crowding: Obvoius but Underappreciated, 26, No. 10 Trends in Biochemical Sciences 597-604 (2001).
Exhibit L, Sanders et al., Use of a Macromolecular Crowding Agent to Dissect Interactions and Define Functions in Transcriptional Activiation by a DNA-Tracking Protein: Bacteriophage T4 Gene 45 Protein and Late Transcription, 91 PNAS 7703-7707 (1994).
Supplemental Information Disclosure Statement for U.S. Appl. No. 14/105,031, filed Sep. 4, 2015.
Response to Office Action for U.S. Appl. No. 14/704,551, filed Oct. 2, 2015.
Response to Final Rejection for U.S. Appl. No. 14/481,339, filed Oct. 2, 2015.
Response to Office Action for U.S. Appl. No. 14/705,719, filed Oct. 2, 2015.
Information Disclosure Statement and Interview Summary for U.S. Appl. No. 14/104,990, filed Oct. 2, 2015.
Hsu, et al.; "Development and Applications of CRISPR-Cas9 for Genome Engineering"; Cell, 157 (6) 1262-78 (2014).
Xu et al., Efficient Genome Engineering in Eukaryotes Using Cas9 From *Streptococcus thermophilus*, Cell. Mol. Life Sci., 72(2):383-99 (2014).
Karvelis et al., crRNA and tracrRNA Guide Cas9-mediated DNA interference in *Streptococcus thermophilus*, RNA Biology, 10(5):841-51 (2013).
Danielsson et al., Thermodynamics of Protein Destabilization in Live Cells, PNAS, 112(40): 12402-07 (2015).
Emails from Thomas J. Kowalksi to USPTO Personnel, dated Oct. 12, 2015 (80 pages).
Advisory Action for U.S. Appl. No. 14/481,339, dated Oct. 23, 2015.
Response to Final Office Action and Interview Summary for U.S. Appl. No. 14/481,339, filed Oct. 30, 2015.
Exhibit C5, Zhang/Broad U.S. Appl. No. 14/481,339 Fails to Make a Prima Facie Case of Anticipation or Obviousness.

Cho et al., Supplementary Information: Targeted genome engineering in human cells with RNA-guided endonucleases, 31(3) Nature Biotech 230-232 (2013).
Bikard et al., CRISPR Interference Can Prevent Nautral Transformation and Virulence Acquisition during In Vivo Bacterial Infection, Cell Host & Microbe 12:177-86 (2012).
Datsenko et al., Molecular Memory of Prior Infections Activates the CRISPR/Cas Adaptive Bacterial Immunity System, Nature Communications 3:945 DOI:10.1038/ncomms 1937 (2012).
Pougach et al., Transcription, Processing, and Function of CRISPR Cassettes in *Escherichia coli*, Mol. Microbiol. 77 (6): 1367-79 (2010).
Banaszewska et al., Proprotein Convertase Subtilisin/Kexin Type 9: A New Target Molecule for Gene Therapy, Cell. Mol. Biol. Letters 17:228-39 (2012).
Koornneef et al., Apolipoprotein B Knockdown by AAV-delivered shRNA Lowers Plasma Cholesterol in Mice, Mol. Therap., 19(4):731-40 (2011).
Mali; et al., Supplementary Materials: RNA-Guided Human Genome Engineering via Cas9, 339 Science 823-826 (2013).
Nomura et al., Low-density Lipoprotein Receptor Gene Therapy Using Helper-Dependent Adenovirus Produces Long-term Protection Against Atherosclerosis in a Mouse Model of Familial Hypercholesterolemia, Gene Therapy 11:1540-48 (2004).
Gabriel et al., An Unbiased Genome-Wide Analysis of Zinc-finger Nucleause Specificity, Nature Biotech. 29(9):816-24 (2011).
Lewis et al., The c-myc and PyMT Oncogenes Induce Different Tumor Types in a Somatic Mouse Model for Pancreatic Cancer, Genes Development 17:3127-38 (2003).
Handel et al., Versatile and Efficient Genome Editing in Human Cells by Combining Zinc-Finger Nucleases with Adeno-Associated Viral Vectors, Human Gene Therapy 23:321-29 (2012).
Asuri et al., Directed Evolution of Adeno-associated Virus for Enhanced Gene Delivery and Gene Targeting in Human Pluripotent Stem Cells, Mol. Therap. 20(2):329-38 (2012).
Christian et al., Supporting Information: Targeting DNA Double-Strand Breaks with TAL Effector Nucelases, Genetics 186:757-61 (2010).
Ellis et al., Zinc-finger nuclease-mediated gene correction using single AAV vector transduction and enhancement by Food and Drug Administration—approved drugs, Gene Therapy 20:35-42 (2013).
Hibbitt et al., RNAi-mediated knockdown of HMG CoA reductase enhances gene expression from physiologically regulated low-density lipoprotein receptor therapeutic vectors in vivo, Gene Therapy 19:463-467 (2012).
Janssen et al., Mouse models of K-ras-initiated carcionogenesis, Biochimica Et Biophysica Acta 1756:145-154 (2005).
E. Deltcheva et al., CRISPR RNA maturation by trans-encoded small RNA and host factor Rnase III, 471 Nature 602-609 (2011) ("Deltcheva") with Supplemental Figures).
H. Deveau et al., Phage Response to CRISPR-Encoded Resistance in *Streptococcus thermophiles* 190(4) J Bacteriol 1390-1400 (2008) ("Deveau").
F. Mojica et al., Short motif sequences determine the targets of the prokaryotic CRISPR defence system, 155 Microbiology 733-40 (2009) ("Mojica").
W. Hwang et al., Efficient genome editing in zebrafish using a CRISPR-Cas system, 31(3) Nature Biotech. 227-229 (2013).
M. Maeder et al., Robust, synergisitc regulation of human gene expression using TALE activators, 10(3) Nat Methods 2430245 (2013).
R. Geißler et al., Transcriptional Activators of Human Genes with Programmable DNA-Specificity, 6(5) PLoS One e19509 (2011).
M. Mahfouz et al., Targeted transcriptional repression using a chimeric TALE-SRDX repressor protein, 78 Plant Mol Biol 311-321 (2012).
JC Miller et al., A TALE nuclease architecture for efficient genome editing, 29(2) Nat Biotechnol 143-148 (2011).
J. Hanna et al., Treatment of Sickle Cell Anemia Mouse Model with iPS Cells Generated from Autologous Skin, 318 Science 1920-23 (2007).
H. Lee et al., Targeted chromosomal deletions in human cells using zinc finger nucleases, 20 Genome Res. 81-89 (2010).

(56) References Cited

OTHER PUBLICATIONS

N. Sanjana et al., A Transcription Activator-Like Effector (TALE) Toolbox for Genome Engineering, 7(1) Nat Protoc 171-192 (2012).
C. Paul et al., Localized Expression of Small RNA Inhibitors in Human Cells, 7 Molecular Therapy 237-247 (2003).
R. Kaufman, Overview of Vector Design for Mammalian Gene Expression, 16 Molecular Biotechnology 151-160 (2000).
S. Hong et al., Functional Analysis of Various Promoters in Lentiviral Vectors at Different Stages of in Vitro Differentiation of Mouse Embryonic Stem Cells, 15(9) Molecular Therapy 1630-1639 (2007).
C. J. Crasto and J. Feng, A Linker: a program to generate linker sequencs for fusion proteins, 13(5) Protein Engin. 309-12 (2000).
W. Tan et al., Fusion proteins consisting of human immunodeficiency virus type 1 integrase and the designed polydactyl zinc finger protein E2C direct integration of viral DNA into specific sites, 78(3) J. Virol. 1301-13 (2004).
R. Gordley et al., Synthesis of programmable integrases, 106(13) PNAS 5053-58 (2009).
C. Gersbach, Targeted plasmid integration into the human genome by an engineered zinc-finger recombinase, 39(17) Nuc. Acids Res. 7868-78 (2011).
S. Hacein-Bey-Abina et al., Sustained correction of X-linked severe combined immunodeficiency by ex vivo gene therapy, 346 N. Engl. J. Med. 1185-93 (2002).
Y. Santiago et al., Targeted gene knockout in mammalian cells by using engineered zinc-finger nucleases, 105(15) PNAS 6809-14 (2008).
G. Cost et al., BAK and BAX deletion using zinc-finger nucleases yields apoptosis-resistant CHO cells. 105(2) Biotechnol. Bioeng. 330-40 (2010).
G.L. Xu & T.H. Bestor, Cytosine methylation targetted to predetermined sequences, 17 Nature Genetics 376-378 (1997).
P. Blancafort et al., Designing transcription factor architectures for drug discovery 66(6) Mol Pharmacol 1361-71 (2004).
PCR Applications Manual 3rd Edition, Roche Diagnostics GmbH 1-340 (2006).
U.S. Appl. No. 61/748,427, filed Jan. 2, 2013, Feng Zhang et al.
U.S. Appl. No. 61/758,468, filed Jan. 30, 2013, Feng Zhang et al.
U.S. Appl. No. 61/769,046, filed Feb. 25, 2013, Feng Zhang et al.
U.S. Appl. No. 61/791,409, filed Mar. 15, 2013, Feng Zhang et al.
U.S. Appl. No. 61/802,174, filed Mar. 15, 2013, Feng Zhang et al.
U.S. Appl. No. 61/806,375, filed Mar. 28, 2013, Feng Zhang et al.
U.S. Appl. No. 61/814,263, filed Apr. 20, 2013, Feng Zhang et al.
U.S. Appl. No. 61/819,803, filed May 6, 2013, Feng Zhang et al.
U.S. Appl. No. 61/828,130, filed May 28, 2013, Feng Zhang et al.
U.S. Appl. No. 61/835,931, filed Jun. 17, 2013, Feng Zhang et al.
U.S. Appl. No. 61/836,127, filed Jun. 17, 2013, Feng Zhang et al.
U.S. Appl. No. 61/717,324, filed Oct. 23, 2012, Jin-Soo Kim et al.
U.S. Appl. No. 61/803,599, filed Mar. 20, 2013, Jin-Soo Kim et al.
U.S. Appl. No. 61/837,481, filed Jun. 20, 2013, Jin-Soo Kim et al.
U.S. Appl. No. 14/942,782, filed Nov. 16, 2015, Doudna et al.
Altshuler et al. National Institute of Diabetes and Digestive and Kidney Diseases, National Institues of Health (NIH) Research Grant No. 1401DK097768-01 submitted by The Broad Institute, Inc., published Oct. 8, 2012.
Campeau et al., "A versatile viral system of expression and depletion of proteins in mammalian cells," PLoS One, 4(8) e6529 (2009).
Urnov et al., "Genome editing with engineered zinc finger nucleases," Nat Rev. Genet. 11:636-646 (2010).
Radulovich et al., "Modified gateway system for double shRNA expression and Cre/Iox based gene expression," BMC Biotechnol., 11:24 (2011).
Joung and Sander "TALENs: a widely applicable technology for targeted genome editing," Nat. Rev. Mol. Cell Biol. 14(1):49-55 (2013).
Xiao et al., "Chromosomal deletions and inversions mediated by TALENs and CRISPR/Cas in zebrafish," Nucl. Acid Res., 1(14): e141; ePub: (2013).

Lemay, et al., "Folding of the Adenine Bioswitch," Chemistry & Biology 13:857-68 (2006).
Espinoza et al., "Characterization of the structure, function, and mechanism of B2 RNA, and ncRNA repressor of RNA polymerase II transcription," RNA 13:583-96 (2007).
Noguchi, et al., "PDX-1 Protein Containing Its Own Antennapedia-Like Protein Transduction Domain Can Transduce Pancreatic Duct and Islet Cells," Diabetes 52:1732-37 (2003).
Tiscornia et al., "Development of Lentiviral Vectors Expressing siRNA," Gene Transfer: Delivery and Expression of DNA and RNA; A labaoratory Manual, Chapter 3:23-24 (2007).
Villion and Molneau, "The double-edged sword of CRISPR-Cas systems," Cell Research, 23:15-17 (2012).
Lewin et al., (Eds), Cells, p. 224 (2007).
Ausubel (Ed), Short Protocols in Molecular Biology, pp. 9-3 to 9-4 (1999).
Perez-Pinera et al., "Advances in Targeted Genome Editing," Curr Opin Chem Biol, 16:268-77 (2012).
Lange, et al., "Classical Nuclear Localization Signals: Definition, Function, and Interaction with Importin a," JBC 282:5101-05 (2007).
Shieh, et al., "Nuclear Targeting of the Maize R Protein Requires Two Nuclear Localization Sequences," Plant Physiol 101:353-61 (1993).
Welch, et al., "Designing Genes for Successful Protein Expression," Methods in Enzymology, vol. 4981, pp. 43-66 (2011).
Mussolino adnd Cathomen, "TALE nucleases: tailored genome engineering made easy," Curr Opin Biotechnol., 23: 644-50 (2012).
Bouard, et al., "Viral Vectors: from virology to transgene expression," British Journal of Pharmacology 157: 153-65 (2009).
Tinland, et al., "The T-DNA-linked VirD2 protein contains two distinct functional nuclear localization signals," Proc. Natl. Acad. Sci., 89:7442-46 (1992).
Li, et al., "Modularly assembled designer TAL effector nucleases for targeted gene knockout and gene replacement in eukaryotes," Nucleic Acids Research, 39(14):6315-25 (2011).
Kiani et al., "Cas9 gRNA engineering for genome editing, activation and repression," Nature Methods, doi:10.1038,nmeth.3580; publishedonline Sep. 7, 2015.
Birch, R.G., "Plant Transformation: Problems and Strategies for Practical Application," Annu. Rev. Plant Physiol Plant Mol. Biol., 48:297-326 (1997).
Kondo, et al., "Highly Improved Gene Targeting by Germline-Specific Cas9 Expression in *Drosophila*," Genetics 195(3): 715-721 (2013).
Sebo, et al., "A simplified and efficient germline-specific CRISPR/Cas9 systems for *Drosphila* genomic engineering," Fly 8(1): 52-57 (2014).
Yu, et al., "Highly Efficient Genome Modifications Mediated by CRISPR/Cas9 in *Drosophila*," Genetics 195(1) 289-91 (2013).
Primo, et al., "Lentiviral vectors for cutaneous RNA managing," Experimental Dermatology 21(3): 162-70 (2012).
Yi, et al., "current Advances in Retroviral Gene Therapy," Current Gene Therapy 11(3):218-28 (2011).
Singer, et al., "Applications of Lentiviral Vectors for sh RNA Delivery and Transgenesis," Curr. Gene Ther. 8(6):483-88 (2008).
Sung, et al., "Mouse genetics: Catalogue and scissors," BMB Reports 45(12):686-92 (2012).
Opposition filed against EP Patent No. EP2771468B1, filed by CRISPR Therapeutics AG, filed Nov. 10, 2015, 47 pages.
Opposition filed against EP Patent No. EP2771468B1, filed by Novozymes A/S, filed Nov. 11, 2015, 21 pages.
Opposition filed against EP Patent No. EP2771468B1, filed by Michalski Huttermann, filed Nov. 11, 2015, 46 pages.
Opposition filed against EP Patent No. EP2771468B1, filed by Boxall Intellectual Property Management Limited, filed Nov. 11, 2015, 51 pages.
Opposition filed against EP Patent No. EP2771468B1, filed by Adams, Harvey Vaughan Joh, filed Nov. 11, 2015, 33 pages.
Opposition filed against EP Patent No. EP2771468B1, filed by Sagittarius Intellectual Property LLP, filed Nov. 11, 2015, 41 pages.
Third Party Observations filed in EP Application No. 13793997, filed Dec. 5, 2014, 8 pages.

(56) References Cited

OTHER PUBLICATIONS

Third Party Observations filed in EP Application No. 13793997, filed Feb. 3, 2015, 3 pages.
Third Party Observations filed in EP Application No. 13793997, filed Feb. 5, 2015, 2 pages.
Yang et al., "One-Step Generation of Mice Carrying Reporter and Conditional Alleles by CRISPR/Cas-Mediated Genome Engineering," Cell 154:1370-1379 (2013).
Opposition filed against EP Patent No. EP2771468B1, filed by Grund Intellectual Property Group, filed Nov. 10, 2015, 73 pages.
Opposition filed against EP Patent No. EP2771468B1, filed by Regimbeau, filed Nov. 10, 2015, 68 pages.
Opposition filed against EP Patent No. EP2771468B1, filed by George W. Schlich, filed Oct. 26, 2015, 51 pages.
Excerpt from Feng Zhang Declaration, dated Jan. 30, 2014.
Paragraphs of Doudna P3 Cited in Office Action in U.S. Appl. No. 14/481,339, dated Oct. 2, 2015.
Granted Claims in EP 2771468 (Feb. 11, 2015), EP 2764103(Aug. 19, 2015), EP 2896697 (Sep. 2, 2015), and EP 2784162 (Apr. 8, 2015).
U.S. Appl. No. 14/105,035 as a Case Study, Oct. 2, 2015.
Pending Claims of GB1420270.9, Jun. 30, 2015.
Exhibit E, Zhang/Broad U.S. Appl. No. 14/105,031 as Doudna U.S. Appl. Nos. 61/652,086 and 61/716,256 Fail to Teach or Suggest Claimed Invention, Oct. 2, 2015.
Exhibit F, Zhang/Broad U.S. Appl. 14/105,035 as Doudna U.S. Appl. Nos. 61/652,086 and 61/716,256 Fail to Teach or Suggest Claimed Invention, Oct. 2, 2015.
Exhibit G, Zhang/Broad U.S. Appl. No. 14/704,551 as Doudna U.S. Appl. Nos. 61/652,086 and 61/716,256 Fail to Teach or Suggest Claimed Invention, Oct. 2, 2015.
Exhibit H, Zhang/Broad U.S. Appl. No. 14/497,627 as Doudna U.S. Appl. Nos. 61/652,086 and 61/716,256 Fail to Teach or Suggest Claimed Invention, Oct. 2, 2015.
Exhibit I, Zhang/Broad U.S. Appl. No. 14/104,990 as Doudna U.S. Appl. Nos. 61/652,086 and 61/716,256 Fail to Teach or Suggest Claimed Invention, Oct. 2, 2015.
Pending Claims in U.S. Appl. No. 14/104,990, filed Jun. 10, 2015.
Pending Claims in U.S. Appl. No. 14/105,031, filed Oct. 2, 2015.
Pending Claims in U.S. Appl. No. 14/105,035, filed Oct. 2, 2015.
Pending Claims in U.S. Appl. No. 14/523,799, filed Mar. 31, 2015.
Pending Claims in U.S. Appl. No. 14/704,551, filed Oct. 29, 2015.
Declaration of Dana Carroll, Ph.D. In Support of Supplemental Suggestion of Interference, filed Nov. 5, 2015.
Office Action Appendix in U.S. Appl. No. 14/105,035 (identical to that in U.S. Appl. Nos. 14/105,031; 14/705,719; 14/104,990; 14/523,799; and 14/703,511), notification date Dec. 31, 2015.
Clustal 2.1 multiple sequence alignment (filed on Apr. 13, 2015) filed as Exhibit 26 of the Declaration of Dr. Dana Carroll, which was filed as Exhibit 53 of the Suggestion of Interference in case U.S. Appl. No. 13/842,859—previously submitted—SBO8—filed Apr. 8, 2016.
Curriculum Vitae of Dana Carroll, Ph.D. (filed on Apr. 13, 2015) filed as Exhibit 46 of the Declaration of Dr. Dana Carroll, which was filed as Exhibit 53 of the Suggestion of Interference in case U.S. Appl. No. 13/842,859.—previously submitted—SBO8—filed Apr. 8, 2016.
Declaration of Dana Carroll, Ph.D. in Support of Suggestion of Interference Pursuant to 37 C.F.R. § 41.202 (filed on Apr. 13, 2015) as Exhibit 53 of the Suggestion of Interference in case U.S. Appl. No. 13/842,859.—previously submitted—SBO8—filed Apr. 8, 2016.
Addgene Reagent distribution list for Zhang Lab (filed on Jun. 30, 2015) filed as Appendix D of Third Party Observations for UK Application No. GB1420270.9.—previously submitted—SBO8—filed Apr. 8, 2016.
Leenay, et al.; "Identifying and Visualizing Functional PAM Diversity across CRISPR-Cas Systems"; Molecular Cell; vol. 62, pp. 1-11 (Apr. 7, 2016).

Supplemental Information (13 pages) for Leenay, et al.; "Identifying and Visualizing Functional PAM Diversity across CRISPR-Cas Systems"; Molecular Cell; vol. 62, pp. 1-11 (Apr. 7, 2016).
Third Party Submissions filed against EP Application No. 13793997.1; filed on (Apr. 20, 2016).
EP Exam Report in EP Application No. 13793997.1 (May 12, 2016).
Jore et al.; "Structural basis for CRISPR RNA-guided DNA recognition by Cascade"; Nat Struct Mol Biol. 18(5):529-36 (May 2011).
U.S. Appl. No. 15/129,382 (national stage entry of PCT/US2015/025147), filed Sep. 26, 2016.
U.S. Appl. No. 15/138,604, filed Apr. 26, 2016.
U.S. Appl. No. 15/090,511, filed Apr. 4, 2016.
US20160319262 (U.S. Appl. No. 15/108,545)(Nov. 3, 2016).
US20160319349 (U.S. Appl. No. 15/159,619) (Nov. 3, 2016).
US20160312280 (U.S. Appl. No. 15/202,518) (Oct. 27, 2016).
US20160298096 (U.S. Appl. No. 15/037,371) (Oct. 13, 2016).
US20160289659 (U.S. Appl. No. 15/036,298) (Oct. 6, 2016).
US20140302563 (U.S. Appl. No. 14/248,980) (Sep. 9, 2014).
US20160138045 (U.S. Appl. No. 14/897,026) (May 19, 2016).
US20160108470 (U.S. Appl. No. 14/977,514) (Apr. 21, 2016).
US20160251640 (U.S. Appl. No. 15/159,776) (Sep. 1, 2016).
US20160076020 (U.S. Appl. No. 14/751,058) (Mar. 17, 2016).
US20160068887 (U.S. Appl. No. 14/751,070) (Mar. 10, 2016).
US20160046963 (U.S. Appl. No. 14/751,088) (Feb. 18, 2016).
US20160046962 (U.S. Appl. No. 14/749,594) (Feb. 18, 2016).
US20160046949 (U.S. Appl. No. 14/749,599) (Feb. 18, 2016).
US20140315985 (U.S. Appl. No. 14/206,319) (Oct. 23, 2014).
US20160289673 (U.S. Appl. No. 15/025,217) (Oct. 6, 2016).
US20160194653 (U.S. Appl. No. 14/960,287) (Jul. 7, 2016).
US20150218573 (U.S. Appl. No. 14/598,599) (Aug. 6, 2015).
US20160024568 (U.S. Appl. No. 14/416,338) (Feb. 16, 2016).
US20160046978 (U.S. Appl. No. 14/751,055) (Feb. 18, 2016).
U.S. Pat. No. 9,260,752 (U.S. Appl. No. 14/416,338) (issued on Feb. 16, 2016).
U.S. Pat. No. 9,410,198 (U.S. Appl. No. 14/751,055) (issued on Aug. 9, 2016).
Charpentier, "CRISPR/CAS: An adaptive immune system against genome invaders", Project Research Grant application submitted confidentially to Swedish Research Council on Apr. 13, 2011 and available no earlier than Nov. 3, 2011.
Swedish Research Council spreadsheet, which may have been available online on or after Nov. 3, 2011 (see entry 2011-5752).
Charpentier, "CRISPR/CAS: An adaptive immune system against genome invaders", Swedish Research Council detailed information for grant decision, which may have been available online on or after Nov. 18, 2011 (and English language translation).
Gonzales et al., "Novel small RNAs in the human pathogen Streptococcus pyogenes revealed by experimental RNomics," International Symposium on Bacterial Cell Biology and Pathogenesis, Umea, Sweden (2009) (Poster) (conference began on Jun. 14, 2009).
Charpentier, "Regulatory small RNAs arid their biological roles in the human pathogen Streptococcus pyogenes," 1$^{st}$ Nordic EMBL Molecular Medicine Network (NMMN), Lycksele, Sweden (2010) (Abstract) (conference began on Aug. 20, 2010).
Chylinski et al., "CRISPR of the human pathogen Streptococcus pyogenes confers immunity against invading virulence factor-encoding lysogenic phages," CRISPR Meeting, Wageningen, The Netherlands (2010) (Abstract) (conference began on Oct. 21, 2010).
Chylinski et al., "CRISPR of the human pathogen Streptococcus pyogenes confers immunity against invading virulence factor-encoding lysogenic phages," CRISPR Meeting, Wageningen, The Netherlands (2010) (Poster) (conference began on Oct. 21, 2010).
Le Rhun et al., "A trans-encoded small RNA and the host factor RNaseIII are essential for the production of active CRISPR crRNAs to confer bacterial immunity against invading genomes," ASM Conference on Regulating with RNA in Bacteria, San Juan, Puerto Rico (2011) (Abstract) (conference began on Mar. 7, 2011).
Le Rhun et al., "A trans-encoded small RNA and the host factor RNaseIII are essential for the production of active CRISPR crRNAs to confer bacterial immunity against invading genomes", ASM Conference on Regulating with RNA in Bacteria, San Juan, Puerto Rico (2011) (Poster) (conference began on Mar. 7, 2011 ).

(56) References Cited

OTHER PUBLICATIONS

Charpentier, "Regulatory processes in Gram-positive pathogens," MIMS Opening Ceremony, Umea, Sweden (2011) (Poster) (May 31, 2011).
Deltcheva et al., "A novel RNA maturation pathway for the production of active CRISPR crRNAs to confer bacterial immunity against invading genomes," 4th Congress of European Microbiologists (FEMS) Meeting, Geneva, Switzerland (2011) (Abstract) (conference began on Jun. 26, 2011).
Deltcheva et al., "The CRISPR/Cas system in Group A Streptococcus: novel RNA maturation pathway and role in the acquisition of invading lysogenic phages," XVIII Lancefield International Symposium on Streptococci arid Streptococcal Diseases, Palermo, Italy (2011) (Abstract) (conference began on Sep. 4, 2011).
Deltcheva et al., "When bacteria get the flu and sharpen their knives: a novel RNA maturation pathway to activate the CRISPR immune system," The EMBO Meeting 2011, Vienna, Austria (Abstract) (conference began on Sep. 10, 2011).
Deltcheva et al., "When bacteria get the flu and sharpen their knives: a novel RNA maturation pathway to activate the CRISPR immune system," The EMBO Meeting 2011, Vienna, Austria (Poster) (conference began on Sep. 10, 2011).
Charpentier, "RNA-guided immunity: a novel RNA maturation pathway for the production of CRISPR RNAs targeting genome invaders," Molecular Life Sciences International Symposium of the German Society for Biochemistry and Molecular Biology (GBM), Frankfurt, Germany (2011) (Abstract) (conference began on Sep. 25, 2011).
Deltcheva et al., "When bacteria get the flu and sharpen their knives: a novel RNA maturation pathway to activate the CRISPR immune system," 2nd Nordic EMBL Molecular Medicine Network (NMMN), Helsinki, Finland (2011) (Abstract) (conference began on Sep. 29, 2011).
Deltcheva et al., "When bacteria get the flu and sharpen their knives: a novel RNA maturation pathway to activate the CRISPR immune system," 2nd Nordic EMBL Molecular Medicine Network (NMMN), Helsinki, Finland (2011) (Poster) (conference began on Sep. 29, 2011).
Charpentier, "When bacteria get the flu and sharpen their knives: a novel RNA maturation pathway to activate the CRISPR immune system," 8th Annual EIMID (European Initiative for Basic Research in Microbiology and Infectious Diseases) Meeting, Novartis Vaccines and Diagnostics, Siena, Italy (2011) (Abstract) (conference began on Oct. 12, 2011).
Charpentier, "crRNA Maturation: a key event in the activation of the CRISPR/Cas immune system," 2012 Meeting of the Dutch Society for Medical Microbiology, Amham, The Netherlands (2012) (Abstract) (conference began on Apr. 17, 2012).
Charpentier, "When bacteria get the flu and sharpen their knives: a novel RNA maturation pathway to activate the CRISPR immune system," Invited seminar at Pasteur Institute, Paris, France (2011) (Abstract) (seminar was on Jun. 24, 2011).
Chylinski et al., "CRISPR of the human pathogen Streptococccus pyogenes confers immunity against invading virulence factor-encoding prophage sequences" CRISPR Meeting, Berkeley, California (2011) (Poster) (conference began on Jul. 12, 2011).
Deltcheva et al., "A novel RNA Maturation Pathway to Activate the CRISPR/Cas Immune System" Swedish National Infection Biology Meeting (NIB), Umeå, Sweden (2011) (Abstract) (conference began Nov. 24, 2011).
Deltcheva et al., "A novel RNA Maturation Pathway to Activate the CRISPR/Cas Immune System"Swedish National Infection Biology Meeting (NIB), Umeå, Sweden (2011) (Poster) (conference began Nov. 24, 2011).
Le Rhun et al., "Genome-wide differential RNA sequencing uncovers novel small RNAs in the human pathogen Streptococcus pyogenes", 4th Congress of European Microbiologists (FEMS) Meeting, Geneva, Switzerland (2011) (Abstract) (conference began on Jun. 26, 2011).

Le Rhun et al., "Novel non-coding RNAs revealed by differential RNA sequencing in the human pathogen Streptococcus pyogenes", ASM Conference on Regulating with RNA in Bacteria, San Juan, Puerto Rico (2011) (Abstract) (conference began on Mar. 7, 2011 ).
Romby and Charpentier, "An overview of RNAs with regulatory functions in gram-positive bacteria," Cell. Mol. Life Sci., 67, 217-237 (2010).
Gottesman, "Dicing defence in bacteria," Nature, 471, 588-589 (2011).
Le Rhun and Charpentier, "Small RNAs in Streptococci," RNA Biology, 9:4, 414-426 (2012) (published online Apr. 1, 2012).
UC Exhibit List [Document Filing Date: Oct. 11, 2016].
Exhibit 1001: U.S. Appl. No. 13/842,859, filed Mar. 15, 2013, to Jennifer Doudna et al. ("the '859 Application") [Document Filing Date: May 23, 2016].
Exhibit 1002: U.S. Patent Application Publication No. 2014/0068797, published on Mar. 6, 2014, to Jennifer Doudna et al. ("the '797 Publication") [Document Filing Date: May 23, 2016].
Exhibit 1003: U.S. Appl. No. 61/652,086, filed May 25, 2012, to Martin Jinek et al. ("the '086 Provisional" or "the First Provisional") [Document Filing Date: May 23, 2016].
Exhibit 1004: U.S. Appl. No. 61/716,256, filed Oct. 19, 2012, to Martin Jinek et al. ("the '256 Provisional" or "the Second Provisional") [Document Filing Date: May 23, 2016].
Exhibit 1005: U.S. Appl. No. 61/757,640, filed Jan. 28, 2013, to Martin Jinek et al. ("the '640 Provisional" or "the Third Provisional") [Document Filing Date: May 23, 2016].
Exhibit 1006: U.S. Appl. No. 61/765,576, filed Feb. 15, 2013, to Wendell Lim et al. ("the '576 Provisional" or "the Fourth Provisional") [Document Filing Date: May 23, 2016].
Exhibit 1007: U.S. Pat. No. 8,597,359, issued on Apr. 15, 2014, to Feng Zhang ("the '359 Patent") [Document Filing Date: May 23, 2016].
Exhibit 1008: U.S. Pat. No. 8,771,945, issued on Jul. 8, 2014, to Feng Zhang ("the '945 Patent") [Document Filing Date: May 23, 2016].
Exhibit 1009: U.S. Pat. No. 8,945,839, issued on Feb. 3, 2015, to Feng Zhang ("the '839 Patent") [Document Filing Date: May 23, 2016].
Exhibit 1010: U.S. Pat. No. 8,889,356, issued on Nov. 18, 2014, to Feng Zhang ("the '356 Patent") [Document Filing Date: May 23, 2016].
Exhibit 1011: U.S. Pat. No. 8,932,814, issued on Jan. 13, 2015, to Le Cong and Feng Zhang ("the '814 Patent") [Document Filing Date: May 23, 2016].
Exhibit 1012: U.S. Pat. No. 8,795,965, issued on Aug. 5, 2014, to Feng Zhang "the '965 Patent") [Document Filing Date: May 23, 2016].
Exhibit 1013: U.S. Pat. No. 8,871,445, issued on Oct. 28, 2014, to Le Cong and Feng Zhang ("the '445 Patent") [Document Filing Date: May 23, 2016].
Exhibit 1014: U.S. Pat. No. 8,865,406, issued on Oct. 21, 2014, to Feng Zhang and Fei Ran ("the '406 Patent") [Document Filing Date: May 23, 2016].
Exhibit 1015: U.S. Pat. No. 8,895,308, issued on Nov. 25, 2014, to Feng Zhang and Fei Ran ("the '308 Patent") [Document Filing Date: May 23, 2016].
Exhibit 1016: U.S. Pat. No. 8,906,616, issued on Dec. 9. 2014, to Feng Zhang et al. ("the '616 Patent") [Document Filing Date: May 23, 2016].
Exhibit 1017: U.S. Pat. No. 8,993,233, issued on Mar. 31, 2015 to Feng Zhang et al. ("the '233 Patent") [Document Filing Date: May 23, 2016].
Exhibit 1018: U.S. Pat. No. 8,999,641, issued on Apr. 7, 2015 to Feng Zhang et al. ("the '641 Patent") [Document Filing Date: May 23, 2016].
Exhibit 1019: U.S. Appl. No. 14/704,551, filed May 5, 2015 to Feng Zhang et al. ("the '551 Application") [Document Filing Date: May 23, 2016].
Exhibit 1020: Diagram depicting the DNA-Binding Domain and DNA-Cleaving Domains of two ZFNs, http://www.sigmaaldrich.

(56) References Cited

OTHER PUBLICATIONS com/life-science/zinc-finger-nuclease- technology/learning-center/ what-is-zfn.html (downloaded on Feb. 3, 2015) [Document Filing Date: May 23, 2016].
Exhibit 1022: Declaration of Caroll Greider, Ph.D., filed May 23, 2016. [Document Filing Date: May 23, 2016].
Exhibit 1023: Curriculum Vitae of Carol Greider, Ph.D., filed May 23, 2016. [Document Filing Date: May 23, 2016].
Exhibit 1024: Declaration of Dana Carroll, Ph.D., filed May 23, 2016. [Document Filing Date: May 23, 2016].
Exhibit 1025: Curriculum Vitae of Dana Carroll, Ph.D., filed May 23, 2016. [Document Filing Date: May 23, 2016].
Exhibit 1028: Mercier et al., A Transcription Factor Cascade Involving Fep1 and the CCAAT-Binding Factor Php4 Regulates Gene Expression in Response to Iron Deficiency in the Fission Yeast Schizosaccharomyces pombe, 5(11) Eukaryotic Cell 1866-1881 (2006) ("Mercier") [Document Filing Date: May 23, 2016].
Exhibit 1029: Dai et al., The Transcription Factors GATA4 and dHAND Physically Interact to Synergistically Activate Cardiac Gene Expression Through a p300-dependent Mechanism, 277(27) J. Biol. Chem. 24390-24398 (2002) ("Dai") [Document Filing Date: Aug. 19, 2016].
Exhibit 1030: Gustafsson et al., Codon Bias and Heterologous Protein Expression, 22(7) Trends Biotechnol. 346-353 (2004) ("Gustafsson") [Document Filing Date: May 23, 2016].
Exhibit 1031: 43 Methods in Cell Biology, Protein Expression in Animal Cells, Chapters 2, 3, 6, 9 (Michael G. Roth ed., 1994) ("Roth") [Document Filing Date: May 23, 2016].
Exhibit 1032: Deltcheva et al., CRISPR RNA maturation by trans-encoded small RNA and host factor RNase III, 471 Nature 602-607 (2011) with Supplementary Materials ("Deltcheva") [Document Filing Date: May 23, 2016].
Exhibit 1033: Sapranauskas et al., The *Streptococcus thermophilus* CRISPR/Cas system provides immunity in *Escherichia coli*, 39(21) Nucl. Acids Res. 9275-9282 (2011) ("Sapranauskas") [Document Filing Date: May 23, 2016].
Exhibit 1034: Wang et al., Targeted gene addition to a predetermined site in the human genome using a ZFN-based nicking enzyme, 22(7) Genome Res. 1316-1326 (2012) ("Wang") [Document Filing Date: May 23, 2016].
Exhibit 1035: Park et al., Regulation of Ribosomal S6 Kinase 2 by Mammalian Target of Rapamycin, 277(35) J. Biol. Chem. 31423-31429 (2002) ("Park") [Document Filing Date: May 23, 2016].
Exhibit 1036: Lieber, The Mechanism of Double-Strand DNA Break Repair by the Nonhomologous DNA End Joining Pathway, 79 Annu. Rev. Biochem. 181-211 (2010) ("Lieber") [Document Filing Date: May 23, 2016].
Exhibit 1037: Jensen et al., An Update on Targeted Gene Repair in Mammalian Cells: Methods and Mechanisms, J. Biomed. Sci. 18:10 (2011) ("Jensen") [Document Filing Date: May 23, 2016].
Exhibit 1038: National Center for Biotechnology Information http://www.ncbi.nlm.nih.gov/protein/403411236?sat=16 &satkey=13804560 (downloaded on Jan. 21, 2015) ("NCBI") [Document Filing Date: May 23, 2016].
Exhibit 1039: Boden et al., Efficient Gene Transfer of HIV-1-Specific Short Hairpin RNA into Human Lymphocytic Cells Using Recombinant Adeno-associated Virus Vectors, 9(3) Mol. Ther. 396-402 (2004) ("Boden") [Document Filing Date: May 23, 2016].
Exhibit 1040: Molecular Cloning: A Laboratory Manual, Chpt. 16 (J. Sambrook & D. Russell, 3rd ed. 2001) ("Sambrook") [Document Filing Date: May 23, 2016].
Exhibit 1041: Nucl. Acids Chem. Biol. Chpt. 4 (B.M. Blackburn et al., 3rd ed. 2006)("Blackburn") [Document Filing Date: Aug. 19, 2016].
Exhibit 1042: Introduction to Genetics a Molecular Approach, Chpt. 6 (T. Brown, 2012) ("Brown") [Document Filing Date: Aug. 19, 2016].

Exhibit 1043: Mahfouz el al., Targeted Transcriptional Repression Using a Chimeric TALE-SRDX Repressor Protein, 78 Plant Mol. Biol. 311-321 (2012) ("Mahfouz") [Document Filing Date: May 23, 2016].
Exhibit 1044: Geißler et al., Transcriptional Activators of Human Genes with Programmable DNA-Specificity, 6(5) PLOS ONE e19509 (2011) ("Geißler") [Document Filing Date: May 23, 2016].
Exhibit 1045: Sanjana et al., A Transcription Activator-like Effector Toolbox for Genome Engineering, 7(1) Nat. Protoc. 171-192 (2012) ("Sanjana") [Document Filing Date: May 23, 2016].
Exhibit 1046: Gordley et al., Synthesis of Programmable Integrases, 106(13) PNAS 5053-5058 (2009) ("Gordley") [Document Filing Date: May 23, 2016].
Exhibit 1047: Xu and Bestor, Cytosine Methylation Targetted to Pre-determined Sequences, 17(4) Nat. Genet. 376-378 (1997) ("Xu") [Document Filing Date: May 23, 2016].
Exhibit 1048: Blancafort et al., Designing Transcription Factor Architectures for Drug Discovery, 66(6) Mol. Pharmacol. 1361-1371 (2004) ("Blancafort") [Document Filing Date: May 23, 2016].
Exhibit 1050: Lee et al., Targeted Chromosomal Deletions in Human Cells Using Zinc Finger Nucleases, 20(1) Genome Res. 81-89 (2010) ("Lee") [Document Filing Date: May 23, 2016].
Exhibit 1055: Cong et al., Multiplex Genome Engineering Using CRISPR/Cas Systems, 339(6121) Science 819-823 (2013) with Supplemental Material ("Cong") [Document Filing Date: May 23, 2016].
Exhibit 1056: Mali et al., RNA-Guided Human Genome Engineering via Cas9, 339(6121) Science 823-826 (2013) with Supplemental Materials ("Mali") [Document Filing Date: May 23, 2016].
Exhibit 1057: Jinek et al., RNA-Programmed Genome Editing in Human Cells, 2 ELIFE e00471 (2013) ("Jinek 2013") [Document Filing Date: May 23, 2016].
Exhibit 1058: Hwang et al., Efficient In Vivo Genome Editing Using RNA-Guided Nucleases, 31(3) Nat. Biotechnol. 227-229 (2013) ("Hwang") [Document Filing Date: May 23, 2016].
Exhibit 1059: Cho et al., Targeted Genome Engineering in Human Cells With the Cas9 RNA-Guided Endonuclease, 31(3) Nat. Biotechnol. 230-232 (2013) with Supplemental Information ("Cho") [Document Filing Date: May 23, 2016].
Exhibit 1060: Shen et al., Generation of gene-modified mice via Cas9/RNA-mediated gene targeting, 23(5) Cell Res. 720-723 (2013) ("Shen") [Document Filing Date: May 23, 2016].
Exhibit 1125: Diagram depicting the DNA-Binding Domains (an array of TAL effector subunits) and DNA-Cleaving Domains of two TALENs, http://www.systembio.com/services_tales (downloaded on Feb. 3, 2015) [Document Filing Date: Aug. 19, 2016].
Exhibit 1126: Nam et al., Cas5d Protein Processes Pre-crRNA and Assembles into a Cascade-like Interference Complex in Subtype I-C/Dvulg CRISPR-Cas System, 20 Structure 1574-1584 (2012) ("Nam") [Document Filing Date: May 23, 2016].
Exhibit 1152: Carroll, A CRISPR approach to gene targeting, 20(9) Molecular Therapy 1658-60 (2012) [Document Filing Date: May 23, 2016].
Exhibit 1153: Garneau et al., The CRISPR/Cas bacterial immune system cleaves bacteriophage and plasmid DNA, 468(7320) Nature 67-71 (2010) [Document Filing Date: Aug. 19, 2016].
Exhibit 1154: Gasiunas et al., Cas9-crRNA ribonucleoprotein complex mediates specific DNA cleavage for adaptive immunity in bacteria. 109(39) PNAS e2579-86 (2012) [Document Filing Date: Aug. 19, 2016].
Exhibit 1155: Jinek et al., A programmable dual-RNA-guided DNA endonuclease in adaptive bacterial immunity, 337(6096) Science 816-821 (2012) ("Jinek 2012") [Document Filing Date: May 23, 2016].
Exhibit 1156: Makarova et al., Evolution and classification of the CRISPR-Cas systems, 9(6) Nat. Rev. Microbiol. 467-477 (2011) [Document Filing Date: May 23, 2016].
Exhibit 1157: McIntyre and Fanning, Design and cloning strategies for constructing shRNA expression vectors, 6 BMC Biotechnol. 1-8 (2006) ("McIntyre") [Document Filing Date: May 23, 2016].

(56) References Cited

OTHER PUBLICATIONS

Exhibit 1158: Paddison et al., Short hairpin RNAs (shRNAs) induce sequence-specific silencing in mammalian cells, 16 Genes & Dev. 948-958 (2002) ("Paddison") [Document Filing Date: May 23, 2016].
Exhibit 1159: Wiedenheft et al., RNA-guided genetic silencing systems in bacteria and archaea, 482(7385) Nature 331-8 (2012) ("Wiedenheft") [Document Filing Date: May 23, 2016].
Exhibit 1160: U.S. Patent Publication No. 2006/0009402, published on Jan. 12, 2006 to Zamore et al. [Document Filing Date: May 23, 2016].
Exhibit 1161: U.S. Patent Publication No. 2010/0076057, published on Mar. 25, 2010 to Sontheimer et al. [Document Filing Date: May 23, 2016].
Exhibit 1162: U.S. Patent Publication No. 2010/0093617, published on Apr. 15, 2010 to Barrangou et al. ("Barrangou I") [Document Filing Date: May 23, 2016].
Exhibit 1163: U.S. Patent Publication No. 2011/0300538, published on Dec. 8, 2011 to Barrangou et al. ("Barrangou II") [Document Filing Date: May 23, 2016].
Exhibit 1164: Supplemental Amendment with Interview Summary and Request for Interview filed in U.S. Appl. No. 14/704,551 on Oct. 29, 2015 ("the '551 Allowed Claims") [Document Filing Date: May 23, 2016].
Exhibit 1165: International PCT Publication No. WO 2013/176772 A1, published on Nov. 28, 2013 [Document Filing Date: May 23, 2016].
Exhibit 1167: Le Rhun et al., Small RNAs in streptococci, 9:4 RNA Biology 414-426, DOI: 10.4161/rna.20104 (Apr. 2012) [Document Filing Date: May 23, 2016].
Exhibit 1168: Li et al., High-efficiency TALEN-based gene editing produces disease-resistant rice, 30(5) Nat Biotechnol. 390-392 (2012) [Document Filing Date: May 23, 2016].
Exhibit 1169: Moore et al., Improved somatic mutagenesis in zebrafish using transcription activator-like effector nucleases (TALENs), 7(5) PLOS ONE 1-9 (2012) [Document Filing Date: May 23, 2016].
Exhibit 1170: Mussolino and Cathomen, TALE nucleases: tailored genome engineering made easy, 23 Curr Opin Biotechnol. 644-650 (2012) [Document Filing Date: Aug. 19, 2016].
Exhibit 1171: Primo et al., Lentiviral vectors for cutaneous RNA managing, 21(3) Experimental Dermatology 162-170 (2012) [Document Filing Date: May 23, 2016].
Exhibit 1172: Swarts et al., CRISPR interference directs strand specific spacer acquisition, 7(4) PLOS ONE e35888 (2012) [Document Filing Date: May 23, 2016].
Exhibit 1173: Terns et al., The CRISPR-Cas system: small RNA-guided invader silencing in prokaryotes, 26 The FASEB J. 353.3 (2012) [Document Filing Date: May 23, 2016].
Exhibit 1174: U.S. Patent Publication No. 2013/0253040, published on Sep. 26, 2013 to Miller et al. [Document Filing Date: May 23, 2016].
Exhibit 1175: U.S. Patent Publication No. 2013/0309670, published on Nov. 21, 2013 to Frendewey et al. [Document Filing Date: May 23, 2016].
Exhibit 1176: U.S. Patent Publication No. 2013/0326645, published on Dec. 5, 2013 to Cost et al. [Document Filing Date: May 23, 2016].
Exhibit 1177: U.S. Patent Publication No. 2013/0326725, published on Dec. 5, 2013 to Shukla et al. [Document Filing Date: Aug. 19, 2016].
Exhibit 1178: U.S. Patent Publication No. 2015/0045546, published on Feb. 12, 2015 to Siksnys et al. [Document Filing Date: Aug. 19, 2016].
Exhibit 1179: U.S. Patent Publication No. 2015/0050699, published on Feb. 19, 2015 to Siksnys et al. [Document Filing Date: Aug. 19, 2016].
Exhibit 1180: U.S. Patent Publication No. 2015/0240261, published on Aug. 27, 2015 to Siksnys et al. [Document Filing Date: May 23, 2016].
Exhibit 1181: U.S. Patent Publication No. 2015/0291961, published on Oct. 15, 2015 to Siksnys et al. [Document Filing Date: May 23, 2016].
Exhibit 1183: International PCT Publication No. WO 2013/126794 A1, published on Aug. 29, 2013 [Document Filing Date: May 23, 2016].
Exhibit 1184: International PCT Publication No. WO 2013/130824 A1, published on Sep. 6, 2013 [Document Filing Date: May 23, 2016].
Exhibit 1185: International PCT Publication No. WO 2013/141680 A1, published on Sep. 26, 2013 [Document Filing Date: May 23, 2016].
Exhibit 1186: International PCT Publication No. WO 2013/142578 A1, published on Sep. 26, 2013 [Document Filing Date: May 23, 2016].
Exhibit 1187: International PCT Publication No. WO 2013/155572 A1, published on Oct. 24, 2013 [Document Filing Date: May 23, 2016].
Exhibit 1188: International PCT Publication No. WO 2013/160230 A1, published on Oct. 31, 2013 [Document Filing Date: May 23, 2016].
Exhibit 1189: International PCT Publication No. WO 2013/169398 A2, published on Nov. 14, 2013 [Document Filing Date: Aug. 19, 2016].
Exhibit 1190: International PCT Publication No. WO 2013/169802 A1, published on Nov. 14, 2013 [Document Filing Date: May 23, 2016].
Exhibit 1191: Aguilera et al., Systemic in vivo distribution of activatable cell penetrating peptides is superior to cell penetrating peptides. 1(5-6) Integr. Biol. 371-381 (2009) [Document Filing Date: May 23, 2016].
Exhibit 1192: Al-Attar et al., Clustered regularly interspaced short palindromic repeats (CRISPRs): the hallmark of an ingenious antiviral defense mechanism in prokaryotes, 392(4) Biol. Chem. 277-289 (2011) [Document Filing Date: May 23, 2016].
Exhibit 1193: Alberts B., et al., Molecular Biology of the Cell, 38, 59 (3rd ed. 1994) [Document Filing Date: May 23, 2016].
Exhibit 1194: Anderson et al., A simple method for the rapid generation of recombinant adenovirus vectors, 7 Gene Therapy 1034-1038 (2000) [Document Filing Date: May 23, 2016 ].
Exhibit 1195: Andreas et al., Enhanced efficiency through nuclear localization signal fusion on phase PhiC31-integrase: activity comparison with Cre and FLPe recombinase in mammalian cells, 30(11) Nucl. Acids Res. 2299-2306 (2002) [Document Filing Date: May 23, 2016].
Exhibit 1196: Asuri et al., Directed Evolution of Adeno-associated Virus for Enhanced Gene Delivery and Gene Targeting in Human Pluripotent Stem Cells, 20(2) Mol. Therap. 329-338 (2012) [Document Filing Date: May 23, 2016].
Exhibit 1197: Ausubel (Ed), Short Protocols in Molecular Biology, pp. 9-3 to 9-4 (1999) [Document Filing Date: May 23, 2016].
Exhibit 1198: Barranger et al., Gene transfer approaches to the lysosomal storage disorders, 24(4) Neurochem Res. 601-615 (1999) [Document Filing Date: Aug. 19, 2016].
Exhibit 1199: Barrangou et al., CRISPR provides acquired resistance against viruses in prokaryotes, 315(5819) Science 1709-1712 (2007) [Document Filing Date: May 23, 2016].
Exhibit 1200: Behr et al., Efficient gene transfer into mammalian primary endocrine cells with lipopolyamine-coated DNA, 86 PNAS 6982-6986 (1989) [Document Filing Date: May 23, 2016].
Exhibit 1201: Beloglazova et al., A novel family of sequence-specific endoribonucleases associated with the clustered regularly interspaced short palindromic repeats, 283(29) J. Biol Chem. 20361-20371 (2008) [Document Filing Date: May 23, 2016].
Exhibit 1202: Beres et al., Genome sequence of a serotype M3 strain of group A *Streptococcus*: phage-encoded toxins, the high-virulence phenotype, and clone emergence, 99(15) Proc Natl Acad Sci USA 10078-10083 (2002) [Document Filing Date: May 23, 2016].
Exhibit 1203: Bergemann et al., Excision of specific DNA-sequences from integrated retroviral vectors via site-specific recombination, 23(21) Nucl. Acids Res. 4451-4456 (1995) [Document Filing Date: May 23, 2016].

(56) References Cited

OTHER PUBLICATIONS

Exhibit 1204: Bhaya et al., CRISPR-Cas Systems in Bacteria and Archaea: Versatile Small RNAs for Adaptive Defense and Regulation, 45 Annual Review of Genetics 273-297 (2011) [Document Filing Date: May 23, 2016].

Exhibit 1205: Biffi et al., Metachromatic leukodystrophy: an overview of current and prospective treatments, 42 Bone Marrow Transplantation S2-S6 (2008) [Document Filing Date: May 23, 2016].

Exhibit 1206: Birch, Plant Transformation: Problems and Strategies for Practical Application, 48 Annu. Rev. Plant Physiol. Plant Mol. Biol. 297-326 (1997) [Document Filing Date: May 23, 2016].

Exhibit 1207: Boch et al., Xanthomonas AvrBs3 family-type III effectors: discovery and function, 48 Annu. Rev. Phytopathol. 419-436 (2010) [Document Filing Date: May 23, 2016].

Exhibit 1208: Bolotin et al., Clustered regularly interspaced short palindrome repeats (CRISPRs) have spacers of extrachromosomal origin, 151(Pt 8) Microbiology 2551-2561 (2005) [Document Filing Date, May 23, 2016].

Exhibit 1209: Bolotin et al., Complete sequence and comparative genome analysis of the dairy bacterium *Streptococcus thermophilus*, 22(12) Nat. Biotechnol. 1554-1558 (2004) [Document Filing Date: May 23, 2016].

Exhibit 1210: Bouard et al., Viral Vectors: from virology to transgene expression, 157 British Journal of Pharmacology 153-165 (2009) [Document Filing Date: May 23, 2016].

Exhibit 1211: Brouns et al., Small CRISPR RNAs guide antiviral defense in prokaryotes, 321 Science 960-964 (2008) [Document Filing Date: May 23, 2016].

Exhibit 1212: Campeau et al., A versatile viral system for expression and depletion of proteins in mammalian cells, 4(8) PLOS ONE e6529 (2009) [Document Filing Date: May 23, 2016].

Exhibit 1213: Carney and Morgan, Induction of DNA Double-Strand Breaks by Electroporation of Restriction Enzymes into Mammalian Cells, 113 Methods in Mol. Biol. 465-471 (1999) [Document Filing Date: May 23, 2016].

Exhibit 1214: Carroll, Genome Engineering Zinc-Finger Nucleases, 188 Genetics 773-782 (2011) [Document Filing Date: May 23, 2016].

Exhibit 1215: Carte et al., Cas6 is an endoribonuclease that generates guide RNAs for invader defense in prokaryotes, 22(24) Genes Dev. 3489-3496 (2008) [Document Filing Date: May 23, 2016].

Exhibit 1216: Cermak et al., Efficient design and assembly of custom TALEN and other TAL effector-based constructs for DNA targeting, 39(12) Nucleic Acids Res. e82 (2011) [Document Filing Date: May 23, 2016].

Exhibit 1217: Chiu et al., Engineered GFP as a vital reporter in plants, 6(3) Curr. Bio. 325-330 (1996) [Document Filing Date: May 23, 2016].

Exhibit 1218: Choulika, et al., Transfer of single gene-containing long terminal repeats into the genome of mammalian cells by a retroviral vector carrying the cre gene and the loxP site, 70(3) J. Virol. 1792-1798 (1996) [Document Filing Date: May 23, 2016].

Exhibit 1219: Christian et al., Targeting DNA double-strand breaks with TAL effector nucleases, 186(2) Genetics 757-761 with Supporting Information (2010) [Document Filing Date: May 23, 2016].

Exhibit 1220: Cost et al., BAK and BAX deletion using zinc-finger nucleases yields apoptosis-resistant CHO cells, 105(2) Biotechnol. Bioeng. 330-340 (2010) [Document Filing Date: May 23, 2016].

Exhibit 1221: Courtin et al., Interactions Between Microorganisms in a Simple Ecosystem: Yogurt Bacteria as a Study Model, 84 LAIT 125-134 (2004) [Document Filing Date: May 23, 2016].

Exhibit 1222: Cradick et al., ZFN-Site Searches Genomes for Zinc Finger Nuclease Target Sites and Off-Target Sites, 12 BMC Bioinformatics 1-10 (2011) [Document Filing Date: May 23, 2016].

Exhibit 1223: Crasto and Feng, A LINKER: a program to generate linker sequences for fusion proteins, 13(5) Protein Engin. 309-312 (2000) [Document Filing Date: May 23, 2016].

Exhibit 1224: Dagnino et al., Molecular diagnosis of analbuminemia: a new case caused by a nonsense mutation in the albumin gene, 12(11) Int J Mol Sci. 7314-7322 (2011) [Document Filing Date: May 23, 2016].

Exhibit 1225: Davis and Cui, Zinc Finger Nucleases for Genome Editing, 30(13) Gen. Eng. & Biotech News 1-3 (2010) [Document Filing Date: May 23, 2016].

Exhibit 1226: Deveau et al., CRISPR/Cas and Its Role in Phage-Bacteria Interactions, 64 Annu. Rev. Microbiol. 475-493 (2010) [Document Filing Date: May 23, 2016].

Exhibit 1227: Deveau et al., Phage Response to CRISPR-Encoded Resistance in *Steptococcus thermophiles*, 190(4) J Bacteriol 1390-1400 (2008) ("Deveau") [Document Filing Date: May 23, 2016].

Exhibit 1228: Drag and Salvesen, DeSUMOylating enzymes—SENPs. 60(11) IUBMB Life 734-742 (2008) [Document Filing Date: May 23, 2016].

Exhibit 1229: Dykxhoorn et al., Killing the Messenger Short RNAs That Silence Gene Expression, 4 Nature Rev. 457-467 (2003) [Document Filing Date: May 23, 2016].

Exhibit 1230: Ellis, Macromolecular crowding: obvious but underappreciated, 26(10) Trends in Biochemical Sciences 597-604 (2001) [Document Filing Date: May 23, 2016].

Exhibit 1231: European Patent No. 2341149 A1, published Jul. 6, 2011 (Danisco A/S) [Document Filing Date: May 23, 2016].

Exhibit 1232: Espinoza et al., Characterization of the structure, function, and mechanism of B2 RNA, an ncRNA repressor of RNA polymerase II transcription, 13 RNA 583-596 (2007) [Document Filing Date: May 23, 2016].

Exhibit 1233: Fechheimer et al., Transfection of mammalian cells with plasmid DNA by scrape loading and sonication loading, 84 PNAS 8463-8467 (1987) [Document Filing Date: May 23, 2016].

Exhibit 1234: Ferretti et al., Complete genome sequence of an M1 strain of *Streptococcus pyogenes*, 98(8) Proc. Natl Acad Sci USA 4658-4663 (2001) [Document Filing Date: May 23, 2016].

Exhibit 1235: Fieck et al., Modifications of the *E. coli* Lac repressor for expression in eukaryotic cells: effects of nuclear signal sequences on protein activity and nuclear accumulation, 20(7) Nucl. Acids Res. 1785-1791 (1992) [Document Filing Date: May 23, 2016].

Exhibit 1236: Fischer-Fantuzzi and Vesco, Cell-Dependent Efficiency of Reiterated Nuclear Signals in a Mutant Simian Virus 40 Oncoprotein Targeted to the Nucleus, 8(12) Mol. Cell Biol. 5495-5503 (1988) [Document Filing Date: May 23, 2016].

Exhibit 1237: Foecking and Hofstetter, Powerful and versatile enhancer-promoter unit for mammalian expression vectors, 45(1) Gene 101-105 (1986) [Document Filing Date: May 23, 2016].

Exhibit 1243: Gabriel el al., An Unbiased Genome-Wide Analysis of Zinc-finger Nuclease Specificity, 29(9) Nature Biotech 816-824 (2011) [Document Filing Date: May 23, 2016].

Exhibit 1244: GenBank Accession No. AAL81255, "hypothetical protein PF1131 [Pyrococcus furiosus DSM 3638]" Feb. 12, 2002 [Document Filing Date: May 23, 2016].

Exhibit 1245: Gentner et al., Identification of hematopoietic stem cell-specific miRNAs enables gene therapy of globoid cell leukodystrophy, 2(58) Sci Transl Med 58ra84 (2010) [Document Filing Date: May 23, 2016].

Exhibit 1246: Gersbach, Targeted plasmid integration into the human genome by an engineered zinc-finger recombinase, 39(17) Nucl. Acids Res. 7868-7878 (2011) [Document Filing Date: May 23, 2016].

Exhibit 1247: Goldfarb et al., Synthetic peptides as nuclear localization signals, 322 Nature 641-644 (1986) [Document Filing Date: May 23, 2016].

Exhibit 1248: Gorman et al., High efficiency gene transfer into mammalian cells, B307 Phil. Trans. R. Sec. Land. 343-346 (1984) [Document Filing Date: May 23, 2016].

Exhibit 1249: Grabowski, Phenotype, diagnosis, and treatment of Gaucher's disease, 372(9645) Lancet. 1263-1271 (2008) [Document Filing Date: May 23, 2016].

Exhibit 1250: Maturase (mitochrondrian) [Neosartorya fischeri] GenBank Accession No. AAX39426 (Nov. 18, 2004) [Document Filing Date: May 23, 2016].

(56) References Cited

OTHER PUBLICATIONS

Exhibit 1251: Gritti, Gene therapy for lysosomal storage disorders, 11(9) Expert Opin Biol Ther. 1153-1167 (2011) [Document Filing Date: May 23, 2016].
Exhibit 1252: Gupta et al., Zinc finger protein-dependent and -independent contributions to the in vivo off-target activity of zinc finger nucleases, 39(1) Nucl. Acids Res. 381- 392 (2011) [Document Filing Date: May 23, 2016].
Exhibit 1253: Hacein-Bey-Abina et al., Sustained correction of X-linked severe combined immunodeficiency by ex vivo gene therapy, 346(16) N. Engl. J. Med. 1185-1193 (2002) [Document Filing Date: May 23, 2016].
Exhibit 1254: Haft et al., A guild of 45 CRISPR-associated (Cas) protein families and multiple CRISPR/Cas subtypes exist in prokaryotic genomes, 1(6) Plos Computational Biology 477-483 (2005) [Document Filing Date: May 23, 2016].
Exhibit 1255: Hale et al., RNA-guided RNA cleavage by a CRISPR RNA-Cas protein complex, 139(5) Cell 945-956 (2009) ("Hale 2009") [Document Filing Date: May 23, 2016].
Exhibit 1256: Hale et al., Essential features and rational design of CRISPR RNAs that function with the Cas RAMP module complex to cleave RNAs, 45(3) Mol Cell 292-302 (2012) ("Hale 2012") [Document Filing Date: May 23, 2016].
Exhibit 1257: Hale et al., Prokaryotic silencing (psi)RNAs in Pyrococcus furiosus, 14(12) RNA 2572-2579 (2008) ("Hale 2008") [Document Filing Date: May 23, 2016].
Exhibit 1258: Händel et al., Versatile and Efficient Genome Editing in Human Cells by Combining Zinc-Finger Nucleases with Adeno-Associated Viral Vectors, 23 Human Gene Therapy 321-329 (2012) [Document Filing Date: May 23, 2016].
Exhibit 1259: Hanna et al., Treatment of Sickle Cell Anemia Mouse Model with iPS Cells Generated from Autologous Skin, 318 Science 1920-1923 (2007) [Document Filing Date: May 23, 2016].
Exhibit 1260: Hashimoto et al., A novel method for transformation of intact yeast cells by electroinjection of plasmid DNA, 21 Applied Microbiol. Biotechnol. 336-339 (1985) [Document Filing Date: May 23, 2016].
Exhibit 1261: Hatoum-Aslan et al., Mature clustered, regularly interspaced, short palindromic repeats RNA (crRNA) length is measured by a ruler mechanism anchored at the precursor processing site, 108(52) PNAS 21218-21222 (2011) [Document Filing Date: May 23, 2016].
Exhibit 1262: Haurwitz et al., Sequence- and structure-specific RNA processing by a CRISPR endonuclease, 329 Science 1355-1358 (2010) [Document Filing Date: May 23, 2016].
Exhibit 1263: Hibbitt et al., RNAi-mediated knockdown of HMG CoA reductase enhances gene expression from physiologically regulated low-density lipoprotein receptor therapeutic vectors in vivo, 19 Gene Therapy 463-467 (2012) [Document Filing Date: May 23, 2016].
Exhibit 1264: Hockemeyer et al., Highly efficient gene targeting of expressed and silent genes in human ESCs and iPSCs using zinc-finger nucleases, 27(9) Nat Biotechnol 851-857 (2009) [Document Filing Date: May 23, 2016].
Exhibit 1265: Hockemeyer et al., Genetic engineering of human ES and iPS cells using TALE nucleases, 29(8) Nature Biotechnology 731-734 (2011) [Document Filing Date: May 23, 2016].
Exhibit 1266: Hofling et al., Human CD34+ hematopoietic progenitor cell-directed lentiviral-mediated gene therapy in a xenotransplantation model of lysosomal storage disease, 9(6) Mod Ther. 856-865 (2004) [Document Filing Date: May 23, 2016].
Exhibit 1267: Hong et al., Functional Analysis of Various Promoters in Lentiviral Vectors at Different Stages of in Vitro Differentiation of Mouse Embryonic Stem Cells, 15(9) Molecular Therapy 1630-1639 (2007) [Document Filing Date: May 23, 2016].
Exhibit 1268: Horvath and Barrangou, CRISPR/Cas, the Immune System of Bacteria and Archaea, 327 Science 167-170 (2010) [Document Filing Date: May 23, 2016].
Exhibit 1269: Horvath et al., Diversity, Activity, and Evolution of CRISPR Loci in *Streptococcus thermophilus*, 190(4) J. Bacteriol. 1401-1412 (2008) [Document Filing Date: May 23, 2016].
Exhibit 1270: Ishino et al., Nucleotide sequence of the lap gene, responsible for alkaline phosphates isozyme conversion in *Escherichia coli*, and identification of the gene product, 169(12) J. Bacteriol. 5429-5433 (1987) [Document Filing Date: May 23, 2016].
Exhibit 1271: Jansen et al., Identification of genes that are associated with DNA repeats in prokaryotes, 43(6) Molecular Microbiology 1565-1575 (2002) [Document Filing Date: May 23, 2016].
Exhibit 1272: Janssen et al., Mouse models of K-ras-initiated carcinogenesis, 1756 Biochimica Et Biophysica Acta 145-154 (2005) [Document Filing Date: May 23, 2016].
Exhibit 1273: Kaufman, Overview of Vector Design for Mammalian Gene Expression, 16 Molecular Biotechnology 151-160 (2000) [Document Filing Date: May 23, 2016].
Exhibit 1274: Kennedy et al., Rapid blue-light induction of protein interactions in living cells, 7(12) Nature Methods 973-975 (2010) [Document Filing Date: May 23, 2016].
Exhibit 1275: Koorneef et al., Apolipoprotein B Knockdown by AAV-delivered shRNA Lowers Plasma Cholesterol in Mice, 19(4) Mol. Therap 731-740 (2011) [Document Filing Date: May 23, 2016 ].
Exhibit 1276: Lambowitz and Zimmerly, Group II introns: mobile ribozymes that invade DNA, 3(8) Cold Spring Harb Perspect Biol. a003616 (2011) [Document Filing Date: May 23, 2016].
Exhibit 1277: Lange et al., Classical Nuclear Localization Signals: Definition, Function, and Interaction with Importin α, 282 J. Biol. Chem. 5101-5105 (2007) [Document Filing Date: May 23, 2016].
Exhibit 1278: Leimig et al., Functional amelioration of murine galactosialidosis by genetically modified bone marrow hematopoietic progenitor cells, 99(9) Blood 3169-3178 (2002) [Document Filing Date: May 23, 2016].
Exhibit 1279: Lemay et al., Folding of the Adenine Bioswitch, 13 Chemistry & Biology 857-868 (2006) [Document Filing Date: May 23, 2016].
Exhibit 1280: Lewin et al. (eds.), Nuclear localization sequences target proteins to the nucleus in Cells 224(5.12) (2007) [Document Filing Date: May 23, 2016].
Exhibit 1281: Lewis et al., The o-myc and PyMT Oncogenes Induce Different Tumor Types in a Somatic Mouse Model for Pancreatic Cancer, 17 Genes Dev. 3127-3138 (2003) [Document Filing Date: May 23, 2016].
Exhibit 1282: Li et al., Modularly assembled designer TAL effector nucleases for targeted gene knockout and gene replacement in eukaryotes, 39(14) Nucl. Acids Res. 6315- 6325 (2011) [Document Filing Date: May 23, 2016].
Exhibit 1283: Li et al., In vivo genome editing restores haemostasis in a mouse model of haemophilia, 475 Nature 217-223 (2011) [Document Filing Date: May 23, 2016].
Exhibit 1284: Lintner et al., Structural and functional characterization of an archaeal clustered regularly interspaced short palindromic repeat (CRISPR)-associated complex for antiviral defense (CASCADE), 286(24) J. Biol Chem. 21643-21656 (2011) [Document Filing Dale: May 23, 2016].
Exhibit 1285: Lombardo et al., Gene editing in human stem cells using zinc finger nucleases and integrase-defective lentiviral vector delivery, 25(11) Nat. Biotechnol. 1298-1306 (2007) [Document Filing Date: May 23, 2016].
Exhibit 1286: Luo et al., Highly parallel identification of essential genes in cancer cells, 105(51) Proc Natl Acad Sci USA 20380-20385 (2008) [Document Filing Date: May 23, 2016].
Exhibit 1287: Makarova et al., Unification of Cas protein families and a simple scenario for the origin and evolution of CRISPR-Cas systems, 6 Biol Direct. 38 (2011) [Document Filing Date: May 23, 2016].
Exhibit 1288: Makarova et al., A putative RNA-interference-based immune system in prokaryotes: computational analysis of the predicted enzymatic machinery, functional analogies with eukaryotic RNAi, and hypothetical mechanisms of action, 1(7) Biol. Direct. 1-26 (2006) [Document Filing Date: May 23, 2016].

(56) References Cited

OTHER PUBLICATIONS

Exhibit 1289: Malanowska et al., CTnDOT integrase performs ordered homology-dependent and homology-independent strand exchanges, 35(17) Nucl. Acids Res. 5861-5873 (2007) [Document Filing Date: May 23, 2016].
Exhibit 1290: Marraffini and Sontheimer, CRISPR interference: RNA-directed adaptive immunity in bacteria and archaea,11(3) Nat Rev Genet. 181-190 (2010) [Document Filing Date: May 23, 2016].
Exhibit 1291: Marraffini and Sontheimer, Self vs. non-self discrimination during CRISPR RNA-directed immunity, 463(7280) Nature 568-571 (2010) [Document Filing Date: May 23, 2016].
Exhibit 1292: Marraffini and Sontheimer, CRISPR interference limits horizontal gene transfer in staphylococci by targeting DNA, 322(5909) Science 1843-1845 (2008) [Document Filing Date: May 23, 2016].
Exhibit 1293: Mastroianni et al., Group II intron-based gene targeting reactions in eukaryotes, 3(9) PLOS ONE. e3121 (2008) [Document Filing Date: May 23, 2016].
Exhibit 1294: Meshorer and Misteli, Chromatin in pluripotent embryonic stem cells and differentiation, 7 Nature Reviews Molecular Cell Biology 540-546 (2006) [Document Filing Date: May 23, 2016].
Exhibit 1295: Miller et al., A TALE nuclease architecture for efficient genome editing, 29(2) Nature Biotechnol. 143-150 (2011) [Document Filing Date: May 23, 2016].
Exhibit 1296: Minton, How Can Biochemical Reactions Within Cells Differ From Those in Test Tubes?, 119 Journal of Cell Science 2863-2869 (2006) [Document Filing Date: May 23, 2016].
Exhibit 1297: Mittelman et al., Zinc-finger directed double-strand breaks within CAG repeat tracts promote repeat instability in human cells. 106(24) Proc Natl. Acad Sci USA 9607-9612 (2009) [Document Filing Date: May 23, 2016].
Exhibit 1298: Mojica et al., Short motif sequences determine the targets of the prokaryotic CRISPR defence system, 155(3) Microbiology 733-740 (2009) with Supplementary Data [Document Filing Date: May 23, 2016].
Exhibit 1299: Mojica et al., Biological significance of a family of regularly spaced repeats in the genomes of Archaea, Bacteria and mitochondria, 36(1) Mol. Microbiol. 244-246 (2000) [Document Filing Date: May 23, 2016].
Exhibit 1300: Mojica et al., Long stretches of short tandem repeats are present in the largest replicons of the Archaea Haloferax mediterranei and Haloferax volcanii and could be involved in replicon partitioning, 17(1) Mol Microbiol 85-93 (1995) [Document Filing Date: May 23, 2016].
Exhibit 1301: Mojica et al., Intervening sequences of regularly spaced prokaryotic repeats derive from foreign genetic elements, 60(2) J. Mol Evol 60(2) 174-182 (2005) [Document Filing Date: May 23, 2016].
Exhibit 1302: Morgan et al., Inducible Expression and Cytogenetic Effects of the EcoRI Restriction Endonuclease in Chinese Hamster Ovary Cells, 8(10) Mol. Cell. Biol. 4204-4211 (1988) [Document Filing Date: May 23, 2016].
Exhibit 1303: Moscou and Bogdanove, A simple cipher governs DNA recognition by TAL effectors, 326(5959) Science 1501 (2009) [Document Filing Date: May 23, 2016].
Exhibit 1304: Mussolino et al., A novel TALE nuclease scaffold enables high genome editing activity in combination with low toxicity, 39(21) Nucl. Acids Res. 9283-9293 (2011) [Document Filing Date: May 23, 2016].
Exhibit 1305: Muzykantov, Drug delivery by red blood cells: vascular carriers designed by mother nature, 7(4) Expert Opin Drug Deliv. 403-427 (2010) [Document Filing Date: May 23, 2016].
Exhibit 1306: Nakamura et al., Codon usage tabulated from international DNA sequence databases: status for the year 2000, 28(1) Nucl. Acids Res. 292 (2000) [Document Filing Date: May 23, 2016].
Exhibit 1307: Neumann et al., Gene transfer into mouse lyoma cells by electroporation in high electric fields, 1(7) EMBO Journal 841-845 (1982) [Document Filing Date: May 23, 2016].

Exhibit 1308: Noguchi et al., PDX-1 Protein Containing Its Own Antennapedia-Like Protein Transduction Domain Can Transduce Pancreatic Duct and Islet Cells, 52 Diabetes 1732-1737 (2003) [Document Filing Date: May 23, 2016].
Exhibit 1309: Nomura et al., Low-density Lipoprotein Receptor Gene Therapy Using Helper-Dependent Adenovirus Produces Long-term Protection Against Atherosclerosis in a Mouse Model of Familial Hypercholesterolemia, 11 Gene Therapy 1540- 1548 (2004) [Document Filing Date: Aug. 19, 2016].
Exhibit 1310: O'Hare et al., Transformation of mouse fibroblasts to methotrexate resistance by a recombinant plasmid expressing a prokaryotic dihydrofolate reductase, 78(3) PNAS 1527-1531 (1981) [Document Filing Date: Aug. 19, 2016].
Exhibit 1311: Olson et al., In vivo characterization of activatable cell penetrating peptides for targeting protease activity in cancer, 1(5-6) Integr. Biol 382-393 (2009) [Document Filing Date: May 23, 2016].
Exhibit 1312: Orlando et al., Zinc-finger nuclease-driven targeted integration into mammalian genomes using donors with limited chromosomal homology, 38(15) Nucl. Acid Res. e152 (2010) [Document Filing Date: May 23, 2016].
Exhibit 1313: Papapetrou et al., Genomic safe harbors permit high β-globin transgene expression in thalassemia induced pluripotent stem cells, 29(1) Nat. Biotechnol 73-78 (2011) [Document Filing Date: May 23, 2016].
Exhibit 1314: Pattanayak et al., Revealing off-target cleavage specificities of zinc-finger nucleases by in vitro selection, 8(9) Nat. Methods 765-770 (2011) [Document Filing Date: May 23, 2016].
Exhibit 1315: Patterson et al., Codon optimization of bacterial luciferase (lux) for expression in mammalian cells, 32(3) J. Ind. Microbiol. Biotechnol. 115-123 (2005) [Document Filing Date: May 23, 2016].
Exhibit 1316: Paul et al., Localized Expression of Small RNA Inhibitors in Human Cells, 7 Molecular Therapy, 237-247 (2003) [Document Filing Date: Aug. 19, 2016].
Exhibit 1317: PCR Applications Manual 3rd ed., 1-340 (Roche Diagnostics GmbH 2006) [Document Filing Date: Aug. 19, 2016].
Exhibit 1318: Perez-Rodiguez et al., Envelope stress is a trigger of CRISPR RNA-mediated DNA silencing in *Escherichia coli*. 79(3) Mol Microbiol. 584-599 (2011) [Document Filing Date: Aug. 19, 2016].
Exhibit 1319: Planey et al., Inhibition of Glucocorticoid-induced Apoptosis in 697 Pre-B Lymphocytes by the Mineralocorticoid Receptor N-terminal Domain, 277(44) J. Biol. Chem. 42188-42196 (2002) [Document Filing Date: Aug. 19, 2016].
Exhibit 1320: Porteus and Carroll, Gene targeting using zinc finger nucleases, 23(8) Nat. Biotechnol. 967-973 (2005) [Document Filing Date: Aug. 19, 2016].
Exhibit 1321: Pougach et al., Transcription, Processing, and Function of CRISPR Cassette in *Escherichia coli*, 77(6) Mol. Microbiol. 1367-1379 (2010) [Document Filing Date: Aug. 19, 2016].
Exhibit 1322: Pourcel et al., CRISPR elements in Yersinia pestis acquire new repeats by preferential uptake of bacteriophage DNA, and provide additional tools for evolutionary studies, 151 Microbiol. Read. Engl. 653-663 (2005) [Document Filing Date: Aug. 19, 2016].
Exhibit 1323: Povirk et al., Role of Braca 1 in Nonhomologous DNA End Joining, U.S. Army Medical Research and Material Command, Award No. DAMD 17-03-01-0620 (Sep. 2004) [Document Filing Date: Aug. 19, 2016].
Exhibit 1324: Radulovich et al., Modified gateway system for double shRNA expression and Cre/lox based gene expression, 11 BMC Biotechnol. 24 (2011) [Document Filing Date: Aug. 19, 2016].
Exhibit 1325: Ramsubir et al., In vivo delivery of human acid ceramidase via cord blood transplantation and direct injection of lentivirus as novel treatment approaches for Farber disease, 95(3) Mol Genet Metab 133-141 (2008) [Document Filing Date: May 23, 2016].
Exhibit 1326: Rand et al., Argonaute2 cleaves the anti-guide strand of siRNA during RISC activation, 123(4) Cell 621-629 (2005) [Document Filing Date: Aug. 19, 2016].

(56) References Cited

OTHER PUBLICATIONS

Exhibit 1327: Raymond and Soriano, High-efficiency FLP and φC31 site-specific recombination in mammalian cells, 2(1) PLOS ONE. e162 (2007) [Document Filing Date: Aug. 19, 2016].
Exhibit 1328: Rebar et al., Induction of angiogenesis in a mouse model using engineered transcription factors, 8(12) Nat. Med. 1427-1432 (2002) [Document Filing Date: Aug. 19, 2016].
Exhibit 1329: Reiss et al., RecA protein stimulates homologous recombination in plants, 93 Proc. Natl. Acad. Sci. USA 3094-3098 (1996) [Document Filing Date: May 23, 2016].
Exhibit 1330: Saito et al., Identification of four acidic amino acids that constitute the catalytic center of the RuvC Holliday junction resolvase, 92 Proc. Natl. Acad. Sci. USA 7470-7474 (1995) [Document Filing Date: May 23, 2016].
Exhibit 1331: Sanders et al., Use of a Macromolecular Crowding Agent to Dissect Interactions and Define Functions in Transcriptional Activation by DNA-Tracking Protein: Bacteriophage T4 Gene 45 Protein and Late Transcription, 91 PNAS 7703-7707 (1994) [Document Filing Date: May 23, 2016].
Exhibit 1332: Sandy et al., Mammalian RNAi: a practical guide, 39 Biotechnioues 215-224 (2005) [Document Filing Date: May 23, 2016].
Exhibit 1333: Santiago et al., Targeted gene knockout in mammalian cells by using engineered zinc-finger nucleases, 105(15) PNAS 5809-14 (2008) with Supporting Information [Document Filing Date: May 23, 2016].
Exhibit 1334: Sato et al., Generation of Adeno-Associated Virus Vector Enabling Functional Expression of Oxytocin Receptor and Fluorescence Marker Genes Using the Human eIF4G Internal Ribosome Entry Site Element, 73(9) Biosci. Biotechnol. Biochem. 2145-2148 (2009) [Document Filing Date: May 23, 2016].
Exhibit 1335: Sauer, Functional expression of the cre-lox site-specific recombination system in the yeast *Saccharomyces cerevisiae*, 7(6) Mol. Cell. Biol. 2087-2096 (1987) ("Sauer 1987") [Document Filing Date: May 23, 2016].
Exhibit 1336: Sauer and Henderson, Site-specific DNA recombination in mammalian cells by the Cre recombinase bacteriophage P1, 85 Proc. Natl. Acad. Sci. USA 5166-5170 (1988) [Document Filing Date: Aug. 19, 2016].
Exhibit 1337: Schramm and Hernandez, Recruitment of RNA polymerase III to its target promoters, 16(20) Genes Dev. 2593-2620 (2002) [Document Filing Date: Aug. 19, 2016].
Exhibit 1338: Shieh et al., Nuclear Targeting of the Maize R Protein Requires Two Nuclear Localization Sequences 101 Plant Physiol 353-361 (1993) [Document Filing Date: Aug. 19, 2016].
Exhibit 1339: Sims et al., High-throughput RNA interference screening using pooled shRNA libraries and next generation sequencing, 12(10) Genome Biol. R104 (2011) [Document Filing Date: Aug. 19, 2016].
Exhibit 1340: Singer and Verma, Applications of Lentiviral Vectors for shRNA Delivery and Transgenesis, 8(6) Curr. Gene Ther. 483-88 (2008) [Document Filing Date: May 23, 2016].
Exhibit 1341: Smith et al., Generation of a Nicking Enzyme that Stimulates Site-Specific Gene Conversion from the I-anil LAGLIDADG Homing Endonuclease, 106(13) PNAS 5099-5104 (2009) [Document Filing Date: Aug. 19, 2016].
Exhibit 1342: Sontheimer et al., Project 7: Establishing RNA-Directed DNA Targeting in Eukaryotic Cells, Project Dates: Nov. 16, 2011 to Dec. 31, 2012 (Feb. 2012) [Document Filing Date: Aug. 19, 2016].
Exhibit 1343: Sorek et al., CRISPR-a widespread system that provides acquired resistance against phages in bacteria and archaea, 6(3) Nat Rev Microbiol. 181-186 (2008) [Document Filing Date: Aug. 19, 2016].
Exhibit 1344: Stern et al., Self-targeting by CRISPR: gene regulation or autoimmunity?, 26(8) Trends Genet. 335-340 (2010) [Document Filing Date: Aug. 19, 2016].
Exhibit 1345: SUEPO Working Paper, A Quality Strategy for the EPO; available at: http://www.suepo.org/public/docs/2002/quality.pdf (2002). [Document Filing Date: May 23, 2016].
Exhibit 1346: Sun et al., Optimized TAL effector nucleases (TALENs) for use in treatment of sickle cell disease, 8(4) Molecular Biosystems 1255-1263 (2012) [Document Filing Date: May 23, 2016].
Exhibit 1347: Symington and Gautier, Double-Strand Break End Resection and Repair Pathway Choice, 45 Annu Rev. Genet. 247-271 (2011) [Document Filing Date: May 23, 2016].
Exhibit 1348: Tan et al., Fusion proteins consisting of human immunodeficiency virus type 1 integrase and the designed polydactyl zinc finger protein E2C direct integration of viral DNA into specific sites, 78(3) J Virol. 1301-1313 (2004) [Document Filing Date: May 23, 2016].
Exhibit 1349: Tanaka et al., Conformational variations in an infectious protein determine prion strain differences, 428(6980) Nature 323-328 (2004) [Document Filing Date: Aug. 19, 2016].
Exhibit 1350: Terns and Terns, CRISPR-based adaptive immune systems, 14(3) Current Opinion in Microbiology. 321-327 (2011) [Document Filing Date: Aug. 19, 2016].
Exhibit 1351: The Glen Report, 19(1) Glen Research (Apr. 2007) [Document Filing Date: Aug. 19, 2016].
Exhibit 1352: Tinland et al., The T-DNA-linked VirD2 protein contains two distinct functional nuclear localization signals, 89 Proc. Natl. Acad. Sci. USA 7442-7446 (1992) [Document Filing Date: May 23, 2016].
Exhibit 1353: Tiscornia et al., Development of Lentiviral Vectors Expressing siRNA in Gene Transfer Delivery and Expression of DNA and RNA, Chpt. 3 (Friedmann & Rossi eds.) (2007) [Document Filing Date: May 23, 2016].
Exhibit 1354: Tolia and Joshua-Tor, Slicer and the argonautes. 3(1) Nat. Chem. Biol. 36-43 (2007) [Document Filing Date: May 23, 2016].
Exhibit 1355: Tsien, The Green Fluorescent Protein, 67 Annu. Rev. Biochem. 509-544 (1998) [Document Filing Date: May 23, 2016].
Exhibit 1356: Urnov et al., Genome editing with engineered zinc finger nucleases, 11 Nat Rev. Genet. 636-646 (2010) [Document Filing Date: Aug. 19, 2016].
Exhibit 1357: Urnov et al., Highly efficient endogenous human gene correction using designed zinc-finger nucleases, 435(7042) Nature 646-651 (2005) [Document Filing Date: Aug. 19, 2016].
Exhibit 1358: van Til et al., Lentiviral gene therapy of murine hematopoietic stem cells ameliorates the Pompe disease phenotype, 115(26) Blood 5329-5337 (2010) [Document Filing Date: May 23, 2016].
Exhibit 1359: Wang et al., Spatiotemporal control of gene expression by a light-switchable transgene system, 9(3) Nature Methods 266-269 (2012) [Document Filing Date: May 23, 2016].
Exhibit 1360: Wang et al., Genetic correction of β-thalassemia patient-specific iPS cells and its use in improving hemoglobin production in irradiated SCID mice, 22(4) Cell Res. 637-648 (2012) [Document Filing Date: May 23, 2016].
Exhibit 1361: Wang et al., Reprogramming erythroid cells for lysosomal enzyme production leads to visceral and CNS cross-correction in mice with Hurler syndrome, 106(47) Proc Natl Acad Sci USA 19958-19963 (2009) [Document Filing Date: May 23, 2016].
Exhibit 1362: Welch et al., Designing Genes for Successful Protein Expression, 493 Methods in Enzymology 43-66 (2011) [Document Filing Date: May 23, 2016].
Exhibit 1363: Wiedenheft et al., Structures of the RNA-guided surveillance complex from a bacterial immune system, 477(7365) Nature 486-489 (2011) [Document Filing Date: May 23, 2016].
Exhibit 1364: Wu et al., Effect of Genome Size on AA V Vector Packaging, 18(1) Mol. Ther. 80-86 (2010) [Document Filing Date: May 23, 2016].
Exhibit 1365: Yi et al., Current Advances in Retroviral Gene Therapy, 11(3) Current Gene Therapy 218-228 (2011) [Document Filing Date: May 23, 2016].
Exhibit 1366: Kim et al., Long-term expression of the human glucocerebrosidase gene in vivo after transplantation of bone-marrow-derived cells transformed with a lentivirus vector, 7(7) J. Gene Med. 878-887 (2005) [Document Filing Date: May 23, 2016].
Exhibit 1367: Zavitz and Marians, A TPase-deficient Mutants of the *Escherichia coli* DNA Replication Protein PriA Are Capable of

(56) References Cited

OTHER PUBLICATIONS

Catalyzing the Assembly of Active Primosomes, 267(10) J. Biol. Chem. 6933-6940 (1992) [Document Filing Date: May 23, 2016].
Exhibit 1368: Zhang et al., cSSMD: assessing collective activity for addressing off-target effects in genome-scale RNA interference screens, 27(20) Bioinformatics 2775-2781 (2011) [Document Filing Date: May 23, 2016].
Exhibit 1369: Zhou et al., Mouse model for the lysosomal disorder galactosialidosis and correction of the phenotype with overexpressing erythroid precursor cells, 9(21) Genes and Dev. 2623-2634 (1995) [Document Filing Dale: May 23, 2016].
Exhibit 1370: Rouillon et al., Structure of the CRISPR Interference Complex CSM Reveals Key Similarities with Cascade, 52(1) Mol. Cell. 124-134 (2013) ("Rouillon") [Document Filing Date: May 23, 2016].
Exhibit 1371: Gratz et al., Genome Engineering of *Drosophila* with the CRISPR RNA-Guided Cas9 Nuclease, 194 Genetics 1029-1035 (2013) ("Gratz") [Document Filing Date: 05/23/2016].
Exhibit 1372: DiCarlo et al., Genome engineering in *Saccharomyces cerevisiae* using CRISPR-Cas systems, 41(7) Nucl. Acids Res. 4336-4343 (2013) ("DiCarlo") [Document Filing Date: May 23, 2016].
Exhibit 1374: Heintze et al., A CRISPR CASe for high-throughput silencing, 4(193) Frontiers in Genetics 1-6 (2013) [Document Filing Date: May 23, 2016].
Exhibit 1375: Xu, The next generation biotechnology for Apple improvement and beyond: The CRISPR/Cas9 Story, 21(4) New York Fruit Quarterly 19-22 (2013) [Document Filing Date: May 23, 2016].
Exhibit 1376: Chen et al., A critical stem-loop structure in the CR4-CR5 domain of mammalian telomerase, 30(2) Nucl. Acids Res. 592-597 (2002) [Document Filing Date: May 23, 2016].
Exhibit 1377: MacRae et al., Structural basis for double-stranded RNA processing by dicer, 311 Science 195-198 (2006) [Document Filing Date: May 23, 2016].
Exhibit 1378: Ma et al., Structural basis for overhang-specific small interfering RNA recognition by the PAZ domain, 429(6989) Nature 318-322 (2004) [Document Filing Date: May 23, 2016].
Exhibit 1379: Sternberg et al., Mechanism of substrate selection by a highly specific CRISPR endoribonuclease, 18 RNA 661-672 (2012) [Document Filing Date: May 23, 2016].
Exhibit 1380: List of Cited References, filed Aug. 19, 2016. [Document Filing Date: Aug. 19, 2016].
Exhibit 1381: Dingwall et al., A polypeptide domain that specifies migration of nucleoplasmin into the nucleus, 30(2) Cell 449-458, Abstract (1982) [Document Filing Date: Aug. 19, 2016].
Exhibit 1382: *Huang v. California Institute of Technology*, 72 U.S.P.Q.2d 1161. 2004 WL 2296330 (C.D. Cal. Feb. 18, 2004) [Document Filing Date: May 23, 2016].
Exhibit 1384: U.S. Pat. No. 5,766,900, issued on Jun. 16. 1998 to Shillito et al. [Document Filing Date: May 23, 2016].
Exhibit 1385: U.S. Pat. No. 5,767,367, issued on Jun. 16, 1998 to Dudits et al. [Document Filing Date: May 23, 2016].
Exhibit 1386: U.S. Pat. No. 7,691,995, issued on Apr. 6, 2010 to Zamore et al. [Document Filing Date: May 23, 2016].
Exhibit 1387: U.S. Pat. No. 8,546,553, issued on Oct. 1, 2013 to Terns et al. [Document Filing Date: May 23, 2016].
Exhibit 1388: U.S. Patent Application Publication No. 2002/0119570, published on Aug. 29. 2002 [Document Filing Date: May 23, 2016].
Exhibit 1389: U.S. Patent Application Publication No. 2002/0182673, published on Dec. 5, 2002 [Document Filing Date: May 23, 2016].
Exhibit 1390: U.S. Patent Application Publication No. 2003/0186238, published on Oct. 2, 2003 [Document Filing Date: May 23, 2016].
Exhibit 1391: U.S. Patent Application Publication No. 2003/0232410, published on Dec. 18, 2003 [Document Filing Date: May 23, 2016].
Exhibit 1392: U.S. Patent Application Publication No. 2004/0111221, published on Jun. 10, 2004 [Document Filing Date: May 23, 2016].
Exhibit 1393: U.S. Patent Application Publication No. 2005/0026157, published on Feb. 3, 2005 [Document Filing Date: May 23, 2016].
Exhibit 1394: U.S. Patent Application Publication No. 2005/0208489, published on Sep. 22, 2005 [Document Filing Date: May 23, 2016].
Exhibit 1395: U.S. Patent Application Publication No. 2006/0234247, published on Oct. 19, 2006 [Document Filing Date: May 23, 2016].
Exhibit 1396: U.S. Patent Application Publication No. 2006/0199190, published on Sep. 7, 2006 [Document Filing Date: May 23, 2016].
Exhibit 1397: U.S. Patent Application Publication No. 2006/0253913, published on Nov. 9, 2006 [Document Filing Date: May 23, 2016].
Exhibit 1398: U.S. Patent Application Publication No. 2007/0016012, published on Jan. 18, 2007 [Document Filing Date: May 23, 2016].
Exhibit 1399: U.S. Patent Application Publication No. 2007/0134796, published on Jun. 14, 2007 [Document Filing Date: May 23, 2016].
Exhibit 1400: U.S. Patent Application Publication No. 2007/0218528, published on Sep. 20, 2007 [Document Filing Date: Aug. 19, 2016].
Exhibit 1401: U.S. Patent Application Publication No. 2008/0124725, published on May 29, 2008 [Document Filing Date: Aug. 19, 2016].
Exhibit 1402: U.S. Patent Application Publication No. 2008/0159996, published on Jul. 3, 2008 [Document Filing Date: Aug. 19, 2016].
Exhibit 1403: U.S. Patent Application Publication No. 2009/0227029, published on Sep. 10, 2009 [Document Filing Date: Aug. 19, 2016].
Exhibit 1404: U.S. Patent Application Publication No. 2010/0055798, published on Mar. 4, 2010 [Document Filing Date: Aug. 19, 2016].
Exhibit 1405: U.S. Patent Application Publication No. 2010/0034924, published on Feb. 11, 2010 [Document Filing Date: Aug. 19, 2016].
Exhibit 1406: U.S. Patent Application Publication No. 2010/0047805, published on Feb. 25, 2010 [Document Filing Date: Aug. 19, 2016].
Exhibit 1407: U.S. Patent Application Publication No. 2010/0055728, published on Mar. 4, 2010 [Document Filing Date: Aug. 19, 2016].
Exhibit 1409: U.S. Patent Application Publication No. 2010/0104690, published on Apr. 29, 2010 [Document Filing Date: Aug. 19, 2016].
Exhibit 1410: U.S. Patent Application Publication No. 2011/0189776, published on Aug. 4, 2011 [Document Filing Date: Aug. 19, 2016].
Exhibit 1411: U.S. Patent Application Publication No. 2011/0002889, published on Jan. 6. 2011 [Document Filing Date: Aug. 19, 2016].
Exhibit 1412: U.S. Patent Application Publication No. 2011/0082093, published on Apr. 7, 2011 [Document Filing Date: Aug. 19, 2016].
Exhibit 1413: U.S. Patent Application Publication No. 2011/0145940, published on Jun. 16, 2011 [Document Filing Date: May 23, 2016].
Exhibit 1414: U.S. Patent Application Publication No. 2011/0182867, published on Jul. 28, 2011 [Document Filing Date: May 23, 2016].
Exhibit 1416: U.S. Patent Application Publication No. 2011/0207221, published on Aug. 25, 2011 [Document Filing Date: Aug. 19, 2016].
Exhibit 1417: U.S. Patent Application Publication No. 2011/0217739, published on Sep. 8, 2011 [Document Filing Date: Aug. 19, 2016].

(56) References Cited

OTHER PUBLICATIONS

Exhibit 1418: U.S. Patent Application Publication No. 2011/0223638, published on Sep. 15, 2011 [Document Filing Date: Aug. 19, 2016].
Exhibit 1419: U.S. Patent Application Publication No. 2011/0236530, published on Sep. 29, 2011 [Document Filing Date: May 23, 2016].
Exhibit 1420: U.S. Patent Application Publication No. 2011/0287545, published on Nov. 24, 2011 [Document Filing Date: May 23, 2016].
Exhibit 1421: U.S. Patent Application Publication No. 2011/0294114, published on Dec. 1, 2011 [Document Filing Date: May 23, 2016].
Exhibit 1422: U.S. Patent Application Publication No. 2011/0301073, published on Dec. 8, 2011 [Document Filing Date: May 23, 2016].
Exhibit 1423: U.S. Patent Application Publication No. 2012/0029891, published on Feb. 2, 2012 [Document Filing Date: May 23, 2016].
Exhibit 1424: U.S. Patent Application Publication No. 2012/0192298, published on Jul. 26, 2012 [Document Filing Date: May 23, 2016].
Exhibit 1425: U.S. Patent Application Publication No. 2013/0011828, published on Jan. 10, 2013 [Document Filing Date: May 23, 2016].
Exhibit 1426: U.S. Patent Application Publication No. 2013/0130248, published on May 23, 2013 [Document Filing Date: May 23, 2016].
Exhibit 1427: U.S. Patent Application Publication No. 2013/0158245, published on Jun. 20, 2013 [Document Filing Date: May 23, 2016].
Exhibit 1428: U.S. Patent Application Publication No. 2013/0288251, published on Oct. 31, 2013 [Document Filing Date: May 23, 2016].
Exhibit 1429: U.S. Patent Application Publication No. 2014/0045176, published on Feb. 13, 2014 [Document Filing Date: May 23, 2016].
Exhibit 1430: U.S. Patent Application Publication No. 2015/0283265, published on Oct. 8, 2015 [Document Filing Date: May 23, 2016].
Exhibit 1431: International PCT Publication No. WO 1988/008450 A1, published on Nov. 3, 1998 [Document Filing Date: May 23, 2016].
Exhibit 1432: International PCT Publication No. WO 2002/034771 A2, published on May 2, 2002 (Abstract) [Document Filing Date: May 23, 2016].
Exhibit 1433: International PCT Publication No. WO 2007/025097 A2, published on Mar. 1, 2007 [Document Filing Date: May 23, 2016].
Exhibit 1434: International PCT Publication No. WO 2007/136815 A2, published on Nov. 29, 2007 [Document Filing Date: May 23, 2016].
Exhibit 1435: International PCT Publication No. WO 2008/108989 A2, published on Sep. 12, 2008 [Document Filing Date: May 23, 2016].
Exhibit 1436: International PCT Publication No. WO 2010/054108 A2, published on May 14, 2010 [Document Filing Date: May 23, 2016].
Exhibit 1437: International PCT Publication No. WO 2010/075424 A2, published on Jul. 1, 2010 [Document Filing Date: May 23, 2016].
Exhibit 1438: International PCT Publication No. WO 2010/117464 A1, published on Oct. 14, 2010 [Document Filing Date: May 23, 2016].
Exhibit 1439: International PCT Publication No. WO 2010/125471 A2, published on Nov. 4, 2010 [Document Filing Date: May 23, 2016].
Exhibit 1440: International PCT Publication No. WO 2011/011767 A1, published on Jan. 27, 2011 [Document Filing Date: May 23, 2016].
Exhibit 1441: International PCT Publication No. WO 2011/146121, published on Nov. 24, 2011 [Document Filing Date: May 23, 2016].
Exhibit 1442: International PCT Publication No. WO 2011/156430 A2, published on Dec. 15, 2011 [Document Filing Date: May 23, 2016].
Exhibit 1443: International PCT Publication No. WO 2011/012738 A1; published on Feb. 3, 2011 [Document Filing Date: May 23, 2016].
Exhibit 1444: International PCT Publication No. WO 2012/164565 A1, published on Dec. 6, 2012 [Document Filing Date: May 23, 2016].
Exhibit 1445: International PCT Publication No. WO 2013/044008 A2, published on Mar. 28, 2013 [Document Filing Date: May 23, 2016].
Exhibit 1446: International PCT Publication No. WO 2013/082519 A2, published on Jun. 6, 2013 [Document Filing Date: May 23, 2016].
Exhibit 1447: International PCT Publication No. WO 2010/076057 A1, published on Jul. 8. 2010 [Document Filing Date: May 23, 2016].
Exhibit 1455: National Center for Biotechnology Information, http://www.ncbi.nlm.nih.gov/protein/Q03LF7.1 (downloaded on Mar. 24, 2015) [Document Filing Date: May 23, 2016].
Exhibit 1456: Nucleotide BLAST® search, https://blast.ncbi.nlm.nih.gov/Blast.cgi (downloaded on Mar. 24, 2015) [Document Filing Date: May 23, 2016].
Exhibit 1457: Kim et al., Precision Genome Engineering with Programmable DNA-Nicking Enzymes; 22 Genome Res. 1327-1333 (2012) [Document Filing Date: May 23, 2016].
Exhibit 1458: Ramirez et al., Engineered zinc finger nickases induce homology-directed repair with reduced mutagenic effects, 40(12) Nucl. Acids Res. 5560-5568 (2012) ("Ramirez") [Document Filing Date: May 23, 2016].
Exhibit 1459: Clustal 2.1 multiple sequence alignment, filed May 23, 2016. [Document Filing Date: May 23, 2016].
Exhibit 1460: Maeder et al., Robust, synergistic regulation of human gene expression using TALE activators, 10(3) Nat Methods 243-245 (2013) [Document Filing Date: May 23, 2016].
Exhibit 1462: Miao et al., Targeted mutagenesis in rice using CRISPR-Cas system, 23 Cell Res. 1233-1236 (2013) [Document Filing Date: May 23, 2016].
Exhibit 1464: Restriction Requirement filed in U.S. Appl. No. 13/842,859, on Feb. 6, 2015 [Document Filing Date: May 23, 2016].
Exhibit 1471: Brouns, A Swiss Army Knife of Immunity, 337 Science 808-809 (2012) [Document Filing Date: May 23, 2016].
Exhibit 1472: Carroll, Genome Engineering with Targetable Nucleases, 83 Annu. Rev. Biochem. 409-439 (2014) [Document Filing Date: May 23, 2016].
Exhibit 1473: Golic, RNA-Guided Nucleases: A New Era for Engineering the Genomes of Model and Nonmodel Organisms, 195 Genetics 303-308 (2013) [Document Filing Date: May 23, 2016].
Exhibit 1475: [Redacted] Email from Shuailiang Lin to Jennifer Doudna, dated Feb. 28, 2015, with attachments [Document Filing Date: Aug. 15, 2016].
Exhibit 1476: Declaration of Dana Carroll, Ph.D. in Support of Suggestion of Interference Pursuant to 37 C.F.R. § 41.202, filed on Apr. 13, 2015 in U.S. Appl. No. 13/842,859 [Document Filing Date: May 23, 2016].
Exhibit 1477: Declaration of Dana Carroll, Ph.D. in Support of Supplemental Suggestion of Interference, filed on Nov. 5, 2015 in U.S. Appl. No. 13/842,859 [Document Filing Date: May 23, 2016].
Exhibit 1479: U.S. Appl. No. 61/613,373, filed Mar. 20, 2012 [Document Filing Date: May 23, 2016].
Exhibit 1480: U.S. Appl. No. 61/625,420, filed Apr. 17, 2012 [Document Filing Date: May 23, 2016].
Exhibit 1481: Beerli et al., Toward controlling gene expression at will: Specific regulation of the erbB-2/HER-2 promoter by using polydactyl zinc finger proteins constructed from modular building blocks, 95 PNAS 14628-14633 (1998) [Document Filing Date: May 23, 2016].
Exhibit 1482: Alberts et al., DNA Binding Motifs in Gene Regulatory Proteins, Molecular Biology of the Cell, 4th ed., pp. 379-395, 1198 (2002) [Document Filing Date: May 23, 2016].

(56) References Cited

OTHER PUBLICATIONS

Exhibit 1483: Jakoby et al., bZIP transcription factors in *Arabidopsis*, 7(3) Trends in Plant Science 106-111 (2002) [Document Filing Date: May 23, 2016].
Exhibit 1484: Aziz et al., Transposases are the most abundant, most ubiquitous genes in nature, 38(13) Nucleic Acids Res. 4207-4217 (2010) [Document Filing Date: May 23, 2016].
Exhibit 1485: Hollis et al., Phage integrases for the construction and manipulation of transgenic mammals, 1:79 Reproductive Biology and Endocrinology (2003) [Document Filing Date: May 23, 2016].
Exhibit 1486: Wang et al, Recombinase technology: applications and possibilities, 30(3) Plant Cell Rep. 267-85 (2011; published online on Oct. 24, 2010) [Document Filing Date: May 23, 2016].
Exhibit 1487: Aravind et al., Survey and Summary: Holliday junction resolvases and related nucleases: identification of new families, phyletic distribution and evolutionary trajectories, 28(18) Nucleic Acids Res. 3417-3432 (2000) [Document Filing Date: May 23, 2016].
Exhibit 1488: Sturm, Invertases. Primary Structures, Functions, and Roles in Plant Development and Sucrose Partitioning, 121(1) Plant Physiology 1-8 (1999) [Document Filing Date: May 23, 2016].
Exhibit 1489: Neitzel, Enzyme Catalysis: The Serine Proteases, 3(9) Nature Education 21 (2010) [Document Filing Date: May 23, 2016].
Exhibit 1490: Davis and Stokoe, Zinc Finger Nucleases as tools to understand and treat human diseases, 8:42 BMC Medicine (2010) [Document Filing Date: May 23, 2016].
Exhibit 1491: Titz et al., Transcriptional activators in yeast, 34(3) Nucleic Acids Res. 955-67 (2006) [Document Filing Date: May 23, 2016].
Exhibit 1492: Wadia and Dowdy, Protein transduction technology, 13(1) Current Opinion Biotechnol. 52-56 (2002). [Document Filing Date: May 23, 2016].
Exhibit 1493: Hewitt, The MHC class I antigen presentation pathway: strategies for viral immune evasion, 110(2) Immunology 163-69 (2003) [Document Filing Date: May 23, 2016].
Exhibit 1494: Terpe, Overview of tag protein fusions: from molecular and biochemical fundamentals to commercial systems, 60 Appl. Microbiol. Biotechnol. 523-533 (2003) [Document Filing Date: May 23, 2016].
Exhibit 1495: Qureshi, β-Lactamase: an ideal reporter system for monitoring gene expression in live eukaryotic cells, 42 Biotechniques 91-96 (2007) [Document Filing Date: May 23, 2016].
Exhibit 1496: Day and Davidson, The fluorescent protein palette: tools for cellular imaging, 38(1) Chem. Soc. Rev. 2887-2921 (2009) [Document Filing Date: May 23, 2016].
Exhibit 1497: Jansa et al., The transcript release factor PTRF augments ribosomal gene transcription by facilitating reinitiation of RNA polymerase I, 29(2) Nucl. Acids Res. 423-32 (2001) [Document Filing Date: May 23, 2016].
Exhibit 1498: Yang and Seto, HATs and HDACs: from structure, function and regulation to novel strategies for therapy and prevention, 26 Oncogene 5310-5318 (2007) [Document Filing Date: May 23, 2016].
Exhibit 1499: Meister et al., Human Argonaute2 Mediates RNA Cleavage Targeted by miRNAs and siRNAs, 15(2) Molecular Cell 185-97 (2004) [Document Filing Date: May 23, 2016].
Exhibit 1501: McConnell Smith et al., Generation of a nicking enzyme that stimulates site-specific gene conversion from the I-AniI LAGLIDADG homing endonuclease, 106(13) PNAS 5099-5104 (2009) [Document Filing Date: May 23, 2016].
Exhibit 1502: M. Kido et al., *Escherichia coli* RecA protein modified with a nuclear localization signal binds to chromosomes in living mammalian cells, 198 Experimental Cell Research 107-114 (1992) [Document Filing Date: May 23, 2016].
Exhibit 1506: Jans et al., Nuclear targeting signal recognition: a key control point in nuclear transport?, 22 Bioessays 532-544 (2000) [Document Filing Date: May 23, 2016].
Exhibit 1507: [Redacted] Martin Jinek notebook, pp. 84-86, filed May 23, 2016. [Document Filing Date: May 23, 2016].

Exhibit 1508: Kim et al., Highly efficient RNA-guided genome editing in human cells via delivery of purified Cas9 ribonucleoproteins, 24 Genome Res. 1012-1019 (2014) with Supplemental Information [Document Filing Date: Aug. 19, 2016].
Exhibit 1509: Cho et al., Heritable Gene Knockout in Caenorhabditis elegans by Direct Injection of Cas9-sgRNA Ribonucleoproteins, 195 Genetics 1177-1180 (2013) with Supplemental Materials and Methods [Document Filing Date: Aug. 19, 2016].
Exhibit 1510: Sung et al., Highly efficient gene knockout in mice and zebrafish with RNA-guided endonucleases, 24 Genome Res. 125-131 (2014) with Supplemental Material [Document Filing Date: Aug. 19, 2016].
Exhibit 1511: Interview Summary with Draft Claim Amendments in U.S. Appl. No. 14/463,253, dated Nov. 3, 2015 [Document Filing Date: Aug. 19, 2016].
Exhibit 1512: Supplemental Amendment filed on Jan. 9, 2014 in U.S. Appl. No. 14/054,414 [Document Filing Date: May 23, 2016].
Exhibit 1513: Office Action dated Jan. 13, 2014 in U.S. Appl. 14/054,414 [Document Filing Date: May 23, 2016].
Exhibit 1514: Claims filed on Dec. 12, 2013 in U.S. Appl. 14/105,017 [Document Filing Date: May 23, 2016].
Exhibit 1515: Office Action dated Nov. 13, 2014 in U.S. Appl. No. 14/105,017 [Document Filing Date: May 23, 2016].
Exhibit 1516: Claims filed on Feb. 18, 2014 in U.S. Appl. No. 14/183,429 [Document Filing Date: Aug. 19, 2016].
Exhibit 1517: Office Action dated Apr. 9, 2014 in U.S. Appl. No. 14/183,429 [Document Filing Date: Aug. 19, 2016].
Exhibit 1518: Second Supplemental Amendment and Interview Summary and Request for interview filed on Oct. 9, 2014 in U.S. Appl. No. 14/256,912 [Document Filing Date: May 23, 2016].
Exhibit 1519: Final Office Action dated Nov. 18, 2014 in U.S. Appl. No. 14/256,912 [Document Filing Date: May 23, 2016].
Exhibit 1520: Supplemental Amendment, Interview Summary, and Request for Interview filed on Oct. 9, 2014 in U.S. Appl. No. 14/226,274 [Document Filing Date: May 23, 2016].
Exhibit 1521: Final Office Action dated Nov. 18, 2014 in U.S. Appl. No. 14/226,274 [Document Filing . Date: May 23, 2016].
Exhibit 1522: Preliminary Amendment filed on Jul. 27, 2015 in U.S. Appl. No. 14/704,551 [Document Filing Date: May 23, 2016].
Exhibit 1523: Office Action dated Aug. 14. 2015 in U.S. Appl. 14/704,551 [Document Filing Date: May 23, 2016].
Exhibit 1524: Claims filed on Feb. 18, 2014 in U.S. Appl. No. 14/183,471 [Document Filing Date: May 23, 2016].
Exhibit 1525: Office Action dated Jul. 1, 2014 in U.S. Appl. No. 14/183,471 [Document Filing Date: May 23, 2016].
Exhibit 1526: Claims filed on Apr. 22, 2014 in U.S. Appl. No. 14/258,458 [Document Filing Date: May 23, 2016].
Exhibit 1527: Office Action dated Jul. 14, 2014 in U.S. Appl. No. 14/258,458 [Document Filing Date: May 23, 2016].
Exhibit 1528: Truant and Cullen, The Arginine-Rich Domains Present in Human Immuodeficiency Virus Type 1 Tat and Rev Function as Direct Importin ß-Dependent Nuclear Localization Signals, 19(2) Molecular and Cellular Biology 1210-1217 (1999) [Document Filing Date: May 23, 2016].
Exhibit 1529: Suggestion of Interference, filed Apr. 13, 2015, in U.S. Appl. No. 13/842,859 without Appendices [Document Filing Date: May 23, 2016].
Exhibit 1530: Supplemental Suggestion of Interference, filed Nov. 5, 2015, in U.S. Appl. No. 13/842,859 without Appendices [Document Filing Date: May 23, 2016].
Exhibit 1531: Zuris et al., Efficient delivery of genome-editing proteins in vitro and in vivo, 33(1) Nat. Biotechnol. 73-80 (2015) [Document Filing Date: May 23, 2016].
Exhibit 1532: Gagnon et al., Efficient mutagenesis by Cas9 protein-mediated oligonucleotide insertion and large-scale assessment of single-guide RNAs, 9(5) PLOS ONE e98186 (2014) [Document Filing Date: May 23, 2016].
Exhibit 1533: Corrected Filing Receipt, dated Dec. 11, 2015 in U.S. Appl. No. 13/842,859 [Document Filing Date: May 23, 2016].
Exhibit 1534: Second Declaration of Carol Greider, Ph.D., filed Aug. 15, 2016. [Document Filing Date: Aug. 15, 2016].

(56) References Cited

OTHER PUBLICATIONS

Exhibit 1535: Second Declaration of Dana Carroll, Ph.D., filed Aug. 15, 2016. [Document Filing Date: Aug. 15, 2016].
Exhibit 1536: Boehm et al., One of three nuclear localization signals of maize Activator (AC) transposase overlaps the DNA-binding domain, 7(3) The Plant Journal 441-451 (1995) [Document Filing Date: Aug. 15, 2016].
Exhibit 1537: Dworetzky et al., The Effects of Variations in the Number and Sequence of Targeting Signals on Nuclear Uptake, 107 Journal of Cell BiOLOGY 1279-1287 (1988) [Document Filing Date: Aug. 15, 2016].
Exhibit 1539: Alberts B., et al., Molecular Biology of the Cell, Chpt. 12, pp. 671-676 (4th ed. 2002) [Document Filing Date: Aug. 15, 2016].
Exhibit 1541: Dang and Lee, Identification of the Human c-myc Protein Nuclear Translocation Signal, 8(10) Molecular and Cellular Biology 4048-4054 (1988) [Document Filing Date: Aug. 15, 2016].
Exhibit 1542: Garcia-Bustos et al., Nuclear Protein Localization, 1071 Biochimica Et Biophysica Acta 83-101 (1991) [Document Filing Date: Aug. 15, 2016].
Exhibit 1543: Greenspan et al., Two Nuclear Location Signals in the influenza Virus NS1 Nonstructural Protein, 62(8) Journal of Virology 3020-3026 (1988) [Document Filing Date: Aug. 15, 2016].
Exhibit 1544: Alberts B., et al., Molecular Biology of the Cell, Chpt. 4, pp. 191-234 (4th ed. 2002) [Document Filing Date: Aug. 15, 2016].
Exhibit 1545: U.S. Appl. No. 61/717,324, filed Oct. 23, 2012 to Seung Woo Kim et al. ("Toolgen Provisional") [Document Filing Date: Aug. 15, 2016].
Exhibit 1546: Yarris, Programmable DNA Scissors Found for Bacterial Immune System (Jun. 28, 2012) downloaded from http://newscenter.lbl.gov/2012/06/28/programmable-dna-scissors/ on Jun. 13, 2016 [Document Filing Date: Aug. 15, 2016].
Exhibit 1547: Qin et al., Systematic Comparison of Constitutive Promoters and the Doxycycline-Inducible Promoter, 5(5) PLOS ONE e10611 (2010) [Document Filing Date: Aug. 15, 2016].
Exhibit 1548: Vence, 'Heroes of CRISPR' Disputed (Jan. 19, 2016), downloaded from The Scientist at http://www.the-scientist.com/?articles.view/articleNo/45119/title/-Heroes-of-CRISPR--Disputed/ on Jul. 29, 2016 [Document Filing Date: Aug. 15, 2016].
Exhibit 1550: Johnson, A social media war just erupted over the biotech innovation of the century in The Washington Post (Jan. 20, 2016) available at https://www.washingtonpost.com/news/wonk/wp/2016/01/20/is-a-history-of-biotechs-hottest-breakthrough-propaganda/ [Document Filing Date: Aug. 15, 2016].
Exhibit 1551: STATNews Controversial CRISPR history sets off an online firestorm downloaded from https://www.statnews.com/2016/01/19/crispr-history-firestorm/ on Jul. 29, 2016 [Document Filing Date: Aug. 15, 2016].
Exhibit 1552: "Internet Outrage is Shaping the Battle Over CRISPR," by Sarah Zhang (Jan. 20, 2016) downloaded from http://www.wired.com/2016/01/crispr-twitter-fight/ on Jul. 29, 2016 [Document Filing Date: Aug. 15, 2016].
Exhibit 1553: Comments on The Heroes of CRISPR, 164 Cell 18-28 (2016) downloaded from http://www.cell.com/cell/comments/S0092-8674(15)01705-5 on Jul. 31, 2016 [Document Filing Date: Aug. 15, 2016].
Exhibit 1554: Hwang et al., Efficient genome editing in zebrafish using a CRISPR-Cas system, 31(3) Nature Biotechnology 227-229 (2013) with Supplementary Materials [Document Filing Date: Aug. 15, 2016].
Exhibit 1555: Simons Deposition Transcript, Jul. 18, 2016 with errata [Document Filing Date: Aug. 15, 2016].
Exhibit 1556: Simons Deposition Transcript, Jul. 19, 2016 with errata [Document Filing Date: Aug. 15, 2016].
Exhibit 1557: [Redacted] Email from Jin-Soo Kim to Jennifer Doudna, dated Jul. 16, 2012 [Document Filing Date: Aug. 15, 2016].
Exhibit 1558: [Redacted] Email from Jin-Soo Kim to Jennifer Doudna, dated Oct. 3, 2012 with attachment [Document Filing Date: Aug. 15, 2016].
Exhibit 1559: Email from George Church to Jennifer Doudna, dated Nov. 14, 2012 [Document Filing Date: Aug. 15, 2016].
Exhibit 1560: [Redacted] Email from George Church to Jennifer Doudna, dated Dec. 8, 2012 with attachments [Document Filing Date: Aug. 15, 2016].
Exhibit 1561: Ran, F. A. CRISPR/Cas9: Tools and Applications for Eukaryotic Genome Editing, 26 North American Agricultural Biotechnology Council Report 69-81 (2014) [Document Filing Date: Aug. 15, 2016].
Exhibit 1562: Seksek et al., Nuclear pH gradient in mammalian cells revealed by laser microspectrofluorimetry, 109 J. Cell. Sci. 257-262 (1996) [Document Filing Date: Aug. 15, 2016].
Exhibit 1563: Kinnevey et al., Emergence of Sequence Type 779 Methicillin-Resistant *Staphylococcus aureus* Harboring a Novel Pseudo Staphylococcal Cassette Chromosome mec (SCCmec)-SCC-SCCCRISPR Composite Element in Irish Hospitals, 57(1) Antimicrob. Agents Chemother, 524-531 (2013) [Document Filing Date: Aug. 15, 2016].
Exhibit 1565: Wang and Carmichael, Effects of Length and Location on the Cellular Response to Double-Stranded RNA, 68(3) Microbiology and Molecular Biology Reviews 432-452 (2004) [Document Filing Date: Aug. 15, 2016].
Exhibit 1566: Südbeck and Scherer, Two Independent Nuclear Localization Signals Are Present in the DNA-Binding High-Mobility Group Domains of SRY and SOX9, 272(44) J. Biol. Chem. 27848-27852 (1997) [Document Filing Date: Aug. 15, 2016].
Exhibit 1569: Lintner et al., Structural and Functional Characterization of an Archaeal Clustered Regularly Interspaced Short Palindromic Repeat (CRISPR)-associated Complex for Antiviral Defense (CASCADE), 286(24) J. Biol. Chem. 21643-21656 (2011) with Supplemental Materials [Document Filing Date: Aug. 15, 2016].
Exhibit 1571: Declaration of Bernardette Rossi, filed Aug. 15, 2016. [Document Filing Date: Aug. 15, 2016].
Exhibit 1572: Esvelt et al., Orthogonal Cas9 proteins for RNA-guided gene regulation and editing, 10(11) Nature Methods 1116-1123 (2013) [Document Filing Date: Aug. 15, 2016].
Exhibit 1573: Friedland et al., Characterization of *Staphylococcus aureus* Cas9: a small Cas9 for all-in-one adeno-associated virus delivery and paired nickase applications, 16:257 Genome Biology 1-10 (2015) [Document Filing Date: Aug. 15, 2016].
Exhibit 1574: Lanza et al., Evaluating the influence of selection markers on obtaining selected pools and stable cell lines in human cells, 8 J. Biotechnol. 811-821 (2013) [Document Filing Date: Aug. 15, 2016].
Exhibit 1575: Mullen et al., Transfer of the bacterial gene for cytosine deaminase to mammalian cells confers lethal sensitivity to 5-fluorocytosine: A negative selection system, 89 PNAS 33-37 (1992) [Document Filing Date: Aug. 15, 2016].
Exhibit 1576: Ill and Chiou, Gene Therapy Progress and Prospects: Recent progress in transgene and RNAi expression cassettes, 12 Gene Therapy 795-802 (2005) [Document Filing Date: Aug. 15, 2016].
Exhibit 1577: Gibson and Shillitoe, Ribozymes—Their Functions and Strategies for Their Use, 7 Mol. Biotechnol. 125-137 (1997) [Document Filing Date: Aug. 15, 2016].
Exhibit 1578: Brisson et al., A novel T7 RNA polymerase autogene for efficient cytoplasmic expression of target genes, 6 Gene Therapy 263-270 (1999) [Document Filing Date: Aug. 15, 2016].
Exhibit 1579: Fuerst et al., Use of a Hybrid Vaccinia Virus-T7 RNA Polymerase System for Expression of Target Genes, 7(7) Mol. and Cell. Biol. 2538-2544 (1987) [Document Filing Date: Aug. 15, 2016].
Exhibit 1580: Dulon and Ryan, The bacterial Neo gene confers neomycin resistance to mammalian cochlear hair cells, 10 Neuroreport 1189-1193 (1999) [Document Filing Date: Aug. 15, 2016].
Exhibit 1581: Mulligan and Berg, Expression of Bacterial Gene in Mammalian Cells, 209 Science 1422-1427 (1980) [Document Filing Date: Aug. 15, 2016].

(56) References Cited

OTHER PUBLICATIONS

Exhibit 1582: Truong et al., Retrohoming of a Mobile Group II Intron in Human Cells Suggests How Eukaryotes Limit Group II Intron Proliferation, 11(8) PLOS GENET. e1005422 (2015) [Document Filing Date: Aug. 15, 2016].
Exhibit 1583: Serganov and Patel, Ribozymes, riboswitches and beyond: regulation of gene expression without proteins, 8 Nature Reviews 776-790 (2007) [Document Filing Date: Aug. 15, 2016].
Exhibit 1584: Lieber et al., Stable High-Level Gene Expression in Mammalian Cells by T7 Phage RNA Polymerase, 217 Methods in Enzymology 47-66 (1993) [Document Filing Date: Aug. 15, 2016].
Exhibit 1585: Lieber et al., High level gene expression in mammalian cells by a nuclear T7-phage RNA polymerase, 17(21) Nucl. Acids Res. 8485-8493 (1989) [Document Filing Date: Aug. 15, 2016].
Exhibit 1586: BD PharmingenTM Technical DataSheet, Red FP Vector—Nucleus, Material No. 558723 (2006) [Document Filing Date: Aug. 15, 2016].
Exhibit 1587: Technical Data Sheet—Clontech's pECFP-Nuc Vector (Aug. 30, 2000) [Document Filing Date: Aug. 15, 2016].
Exhibit 1588: Technical Data Sheet—Clontech's pIRES2-AcGFP1-Nuc Vector (Jul. 5, 2006) [Document Filing Date: Aug. 15, 2016].
Exhibit 1589: Luo et al., Multiple Nuclear Localization Sequences Allow Modulation of 5-Lipoxygenase Nuclear Import, 5 Traffic 847-854 (2004) [Document Filing Date: Aug. 15, 2016].
Exhibit 1590: Technical Data Sheet—Clontech's pDsRed2-Nuc Vector (May 9, 2006) [Document Filing Date: Aug. 15, 2016].
Exhibit 1591: Technical Data Sheet—Clontech's pHcRed1-Nuc Vector (Mar. 11, 2003) [Document Filing Date: Aug. 15, 2016].
Exhibit 1592: Los et al., HalotagTM Technology: Cell Imaging and Protein Analysis, 14 Cell Notes 10-14 (2006) [Document Filing Date: Aug. 15, 2016].
Exhibit 1593: Lyssenko et al., Cognate putative nuclear localization signal effects strong nuclear localization of a GFP reporter and facilitates gene expression studies in Caenorhabditis elegans, 43(5) Biotechniques 596-600 (2007) [Document Filing Date: Aug. 15, 2016].
Exhibit 1594: Maury et al., Technical advances to genetically engineering human embryonic stem cells, 3 Integr. Biol. 717-723 (2011) [Document Filing Date: Aug. 15, 2016].
Exhibit 1595: Nagy et al., Creation and Use of a Cue Recombinase Transgenic Database, Gene Knockout Protocols, Chpt. 19, pp. 365-378 (Ralf Kühn, Wolfgang Worst eds. 2nd ed. 2009) [Document Filing Date: Aug. 15, 2016].
Exhibit 1596: Karow et al., Site-specific recombinase strategy to create iPS cells efficiently with plasmid DNA, 29(11) Stem Cells 1696-1704 (2011) [Document Filing Date: Aug. 15, 2016].
Exhibit 1597: Chen et al., A Facile System for encoding Unnatural Amino Acids in Mammalian Cells, 48(22) Angew Chem. Int. Ed. Engl. 4052-4055 (2009) [Document Filing Date: Aug. 15, 2016].
Exhibit 1598: [Redacted] Email from Jin-Soo Kim to Emmanuelle Charpentier, Ines Fonfara, and Jennifer Dounda, dated Oct. 4, 2012 [Document Filing Date: Aug. 15, 2016].
Exhibit 1599: U.S. Patent Application Publication No. 2015/0322457, published on Nov. 12, 2015 to Kim et al. ("the published Kim application") [Document Filing Date: Aug. 15, 2016].
Exhibit 1600: Molecular Cloning: A Laboratory Manual, Chpt. 9, Protocol 16 (J.Sambrook & D. Russell, 3rd ed. 2001) [Document Filing Date: Aug. 15, 2016].
Exhibit 1601: Office Action dated Dec. 5, 2013 in U.S. Appl. No. 14/054,414 with Notice of References Cited [Document Filing Date: Aug. 15, 2016].
Exhibit 1602: Petition and Request Under 37 C.F.R. § 1.48(d) to Correct Inventorship, filed on Dec. 11, 2013 in U.S. Appl. No. 61/736,527 [Document Filing Date: Aug. 15, 2016].
Exhibit 1603: Timeline of Reports of CRISPR-Cas9 in Eukaryotes Rapidly Submitted Following Senior Party's Disclosure, filed Sep. 28, 2016. [Document Filing Date: Sep. 28, 2016].

Exhibit 1604: Bikard et al., Programmable repression and activation of bacterial gene expression using an engineered CRISPR-Cas system, 41(15) Nucl. Acids Res. 7429-7439 (2013) [Document Filing Date: Sep. 28, 2016].
Exhibit 1605: Wu et al., Genome-wide binding of the CRISPR endonuclease Cas9 in mammalian cells, 32(7) Nat. Biotechnol. 670-676 (2014) [Document Filing Date: Sep. 28, 2016].
Exhibit 1606: Tzur et al., Heritable Custom Genomic Modifications in Caenorhabditis elegans via a CRISPR-Cas9 System, 195 Genetics 1181-1185 (2013) [Document Filing Date: Sep. 28, 2016].
Exhibit 1607: Mali et al., CAS9 transcriptional activators for target specificity screening and paired nickases for cooperative genome engineering, 31(9) Nat. Biotechnol. 833-838 (2013) [Document Filing Date: Sep. 28, 2016].
Exhibit 1608: Koo et al., Measuring and Reducing Off-Target Activities of Programmable Nucleases Including CRISPR-Cas9, 38(6) Mol. Cells 475-481 (2015) [Document Filing Date: Sep. 28, 2016].
Exhibit 1609: Ding et al., Entranced efficiency of human pluripotent stem cell genome editing through replacing TALENs with CRISPRs, 12(4) Cell Stem Cell 393-394 (2013) [Document Filing Date: Sep. 28, 2016].
Exhibit 1610: Gaj et al., ZFN, TALEN and CRISPR/Cas-based methods for genome engineering, 31(7) Trends Biotechnol. 397-405 (2013) [Document Filing Date: Sep. 28, 2016].
Exhibit 1611: Figures 5 and 6 of U.S. Appl. No. 61/652,086 (Ex. 1003) annotated by Dr. Simons on Sep. 15, 2016 [Document Filing Date: Sep. 28, 2016].
Exhibit 1612: Curriculum Vitae of Prashant Mali, Apr. 7, 2016 [Document Filing Date: Sep. 28, 2016].
Exhibit 1613: Luhan Yang's biography, http://genetics.med.harvard.edu/lab/church/lyang, Aug. 30, 2016 [Document Filing Date: Sep. 28, 2016].
Exhibit 1614: Summary of CRISPR work during Oct. 2011-Jun. 2012 presented by Shuailiang Lin (Exhibit 14 to Neville Sanjana Declaration, dated Jul. 23, 2015) [Document Filing Date: Sep. 28, 2016].
Exhibit 1615: Submission in U.S. Appl. No. 14/704,551 on Jan. 5, 2016, Shuailiang Lin notebook, Emails, Nucleotide Sequences, and PowerPoint Slides [Document Filing Date: Sep. 28, 2016].
Exhibit 1616: Shuailiang Lin notebook pages (Exhibit 3 to Neville Sanjana Declaration, dated Jul. 23, 2015) [Document Filing Date: Sep. 28, 2016].
Exhibit 1617: Email from Shuailiang Lin to Feng Zhang and Neville Sanjana dated Nov. 5, 2011 (Exhibit 4 to Neville Sanjana Declaration, dated Jul. 23, 2015) [Document Filing Date: Sep. 28, 2016].
Exhibit 1618: PowerPoint Slides submitted as Exhibit 13 to Neville Sanjana Declaration, dated Jul. 23, 2015 [Document Filing Date: Sep. 28, 2016].
Exhibit 1619: Grant Application for Isogenic human pluripotent stem cell-based models of human disease mutations submitted to National Institutes of Health on Jan. 12, 2012 [Document Filing Date: Sep. 28, 2016].
Exhibit 1620: Email from Feng Zhang to Jennifer Doudna dated Jan. 2, 2013 [Document Filing Date: Sep. 28, 2016].
Exhibit 1621: Zhang et al., Processing-Independent CRISPR RNAs Limit Natural Transformation in Neisseria meningitidis 50(4) Mol. Cell 488-503 (2013) [Document Filing Date: Sep. 28, 2016].
Exhibit 1622: Katic and Großhans, Targeted Heritable Mutation and Gene Conversion by Cas9-CRISPR in Caenorhabditis elegans, 195 Genetics 1173-1176 (2013) [Document Filing Date: Sep. 28, 2016].
Exhibit 1623: Li et al., Multiplex and homologous recombination-mediated plant genome editing via guide RNA/Cas9, 31(8) Nat. Biotechnol. 688-691 (2013) [Document Filing Date: Sep. 28, 2016].
Exhibit 1624: Musunuru, Genome editing of human pluripotent stem cells to generate human cellular disease models, published online Jun. 10, 2013, downloaded from on Sep. 10, 2016 https://www.ncbi.nlm.nih.gov/pmc/articles/PMC3701209/?report=printable [Document Filing Date: Sep. 28, 2016].
Exhibit 1625: Ousterout et al., Multiplex CRISPR/Cas9-Based Genome Editing for Correction of Dystrophin Mutations that Cause Duchenne Muscular Dystrophy, 6 Nat. Commun. 6244 (2015) [Document Filing Date: Sep. 28, 2016].

(56) References Cited

OTHER PUBLICATIONS

Exhibit 1626: Perez-Pinera et al., RNA-guided gene activation by CRISPR-Cas9-based transcription factors, 10(10) Nat. Methods 973-976 (2013) [Document Filing Date: Sep. 28, 2016].
Exhibit 1627: Richter et al., Exploiting CRISPR/Cas: Interference Mechanisms and Applications, 14 Int. J. Mol. Sci 14518-14531 (2013) [Document Filing Date: Sep. 28, 2016].
Exhibit 1628: U.S. Appl. No. 61/717,324, filed Oct. 23, 2012 to Seung Woo Kim et al. ("Toolgen Provisional") [Document Filing Date: Sep. 28, 2016].
Exhibit 1629: Recipients of the 2015 Breakthrough Prizes in Fundamental Physics and Life Sciences Announced, downloaded from https://breakthroughprize.org/News/21 on Sep. 7, 2016 [Document Filing Date: Sep. 28, 2016].
Exhibit 1630: Alpert Prize Recognizes CRISPR Pioneers downloaded from https://hms.harvard.edu/news/alpert-prize-recognizes-crispr-pioneers on Sep. 7, 2016 [Document Filing Date: Sep. 28, 2016].
Exhibit 1631: Crispr: Scientist who awarded patents on gene-editing excluded from Warren Alpert Foundation Prize, Steve Connor Science Editor (Mar. 9, 2016) downloaded from http://www.independent.co.uk/news/science/crispr-scientist- who-awarded-patents-on-gene-editing-excluded-from-warren-alpert-foundation- prize-a6921541.html on Sep. 7, 2016 [Document Filing Date: Sep. 28, 2016].
Exhibit 1632: Press Release, FNIH Awards Lurie Prize to Jennifer Doudna (Feb. 24, 2014), available at http://www.fnih.org/news/press-releases/lurie-prize-in-the- biomedical-sciences-to-jennifer-doudna [Document Filing Date: Sep. 28, 2016].
Exhibit 1633: Press Release, The Gruber Foundation, Yale University, 2015 Gruber Genetics (Jun. 16, 2015) available at http://gruber.yale.edu/genetics/press/2015-druber- genetics-press-release [Document Filing Date: Sep. 28, 2016].
Exhibit 1634: Pioneering research laying the foundations for revolutions in modern biochemistry, downloaded from https://www.knaw.nl/en/awards/heineken- prizes/jennifer-doudna on Sep. 7, 2016 [Document Filing Date: Sep. 28, 2016].
Exhibit 1635: Time Magazine 100 Pioneers: Emmanuelle Charpentier & Jennifer Doudna—Creators of gene-editing technology by Mary-Claire King (Apr. 16, 2015) available at http://time.com/3822554/emmanuelle-charpentier-jennifer-doudna- 2015-time-100/ [Document Filing Date: Sep. 28, 2016].
Exhibit 1636: CRISPR array drawing by Paul Simons, Sep. 15, 2016 [Document Filing Date: Sep. 28, 2016].
Exhibit 1637: Supplemental Figures of Exhibit 1060: Shen et al., Generation of gene-modified mice via Casa/RNA-mediated gene targeting, 23(5) Cell Res. 720-723 (2013) [Document Filing Date: Sep. 28, 2016].
Exhibit 1638: Deposition Transcript of Ronald Breaker, Ph.D., Sep. 13, 2016, with errata [Document Filing Date: Sep. 28, 2016].
Exhibit 1639: Deposition Transcript of Paul Simons, Ph.D., Sep. 2016, with errata [Document Filing Date: Sep. 28, 2016].
Exhibit 1640: Senior Party Objections to Evidence served on May 31, 2016 [Document Filing Date: Oct. 11, 2016].
Exhibit 1641: Senior Party Objections to Evidence served on Aug. 22, 2016 [Document Filing Date: Oct. 11, 2016].
Broad Exhibit List [Document Filing Date: Oct. 11, 2016].
Exhibit 2001: Declaration of Dr. Paul Simons, executed May 23, 2016. [Document Filing Date: May 23, 2016].
Exhibit 2002: Curriculum Vitae of Dr. Paul Simons. [Document Filing Date: May 23, 2016].
Exhibit 2003: Second Declaration of Dr. Paul Simons, executed Jun. 22, 2016. [Document Filing Date: Jun. 22, 2016].
Exhibit 2004: Declaration of Paul D. Margolis, executed Jun. 22, 2016. [Document Filing Date: Jun. 22, 2016].
Exhibit 2005: Deposition Transcript of Dr. Carol Greider, Jul. 20, 2016. [Document Filing Date: Aug. 15, 2016].
Exhibit 2006: Deposition Transcript of Dr. Carol Greider, Jul. 21, 2016. [Document Filing Date: Aug. 15, 2016].
Exhibit 2007: Deposition Transcript of Dr. Dana Carroll, Jul. 21, 2016. [Document Filing Date: Aug. 15, 2016].
Exhibit 2008: Deposition Transcript of Dr. Dana Carroll, Jul. 22, 2016. [Document Filing Date: Aug. 15, 2016].
Exhibit 2009: Third Declaration of Dr. Paul Simons, executed Aug. 15, 2016. [Document Filing Date: Aug. 15, 2016].
Exhibit 2010: Declaration of Dr. Ronald Breaker, executed Aug. 15, 2016. [Document Filing Date: Aug. 15, 2016].
Exhibit 2011: Curriculum Vitae of Dr. Ronald Breaker. [Document Filing Date: Aug. 15, 2016].
Exhibit 2012: Second Deposition Transcript of Dr. Dana Carroll, Sep. 13, 2016. [Document Filing Date: Oct. 11, 2016].
Exhibit 2013: Second Deposition Transcript of Dr. Carol Greider, Sep. 16, 2016. [Document Filing Date: Oct. 11, 2016].
Exhibit 2101: U.S. Appl. No. 61/736,527, filed Dec. 12, 2012. [Document Filing Date: May 23, 2016].
Exhibit 2102: U.S. Patent Publication No. 2014/0068797. [Document Filing Date: May 23, 2016].
Exhibit 2103: Studier et al., U.S. Pat. No. 4,952,496, Aug. 28, 1990. [Document Filing Date: May 23, 2016].
Exhibit 2104: Reiss et al., U.S. Pat. No. 6,583.336, Jun. 24, 2003. [Document Filing Date: May 23, 2016].
Exhibit 2105: U.S. Appl. No. 14/054,414, filed Oct. 15, 2013. [Document Filing Date: May 23, 2016].
Exhibit 2106: U.S. Appl. No. 14/104,977, filed Dec. 12, 2013. [Document Filing Date: May 23, 2016].
Exhibit 2107: U.S. Appl. No. 14/104,990, filed Dec. 12, 2013. [Document Filing Date: May 23, 2016].
Exhibit 2108: U.S. Appl. No. 14/105,017, filed Dec. 12, 2013. [Document Filing Date: May 23, 2016].
Exhibit 2109: U.S. Appl. No. 14/105,031, filed Dec. 12, 2013. [Document Filing Date: May 23, 2016].
Exhibit 2110: U.S. Appl. No. 14/105,035, filed Dec. 12, 2013. [Document Filing Date: May 23, 2016].
Exhibit 2111: U.S. Appl. No. 14/183,429, filed Feb. 18, 2014. [Document Filing Date: May 23, 2016].
Exhibit 2112: U.S. Appl. No. 14/183,471, filed Feb. 18, 2014. [Document Filing Date: May 23, 2016].
Exhibit 2113: U.S. Appl. No. 14/183,486, filed Feb. 18, 2014. [Document Filing Date: May 23, 2016].
Exhibit 2114: U.S. Appl. No. 14/222,930, filed Mar. 24, 2014. [Document Filing Date: May 23, 2016].
Exhibit 2115: U.S. Appl. No. 14/256,912, filed Apr. 18, 2014. [Document Filing Date: May 23, 2016].
Exhibit 2116: U.S. Appl. No. 14/258,458, filed Apr. 22, 2014. [Document Filing Date: May 23, 2016].
Exhibit 2117: U.S. Appl. No. 14/259,420, filed Apr. 23, 2014. [Document Filing Date: May 23, 2016].
Exhibit 2118: U.S. Appl. No. 14/703,511, filed May 4, 2015. [Document Filing Date: May 23, 2016].
Exhibit 2119: U.S. Appl. No. 14/226,274, filed Mar. 26, 2014. [Document Filing Date: May 23, 2016].
Exhibit 2120: U.S. Appl. No. 14/290,575, filed May 29, 2014. [Document Filing Date: May 23, 2016].
Exhibit 2121: U.S. Appl. No. 14/293,498, filed Jun. 2, 2014. [Document Filing Date: May 23, 2016].
Exhibit 2122: Zhang et al., WO 2014/093655, filed Dec. 12, 2013. [Document Filing Date: May 23, 2016].
Exhibit 2123: Zhang et al., WO 2014/093712, filed Dec. 12, 2013. [Document Filing Date: May 23, 2016].
Exhibit 2124: U.S. Appl. No. 61/802,174, filed Mar. 15, 2013. [Document Filing Date: May 23, 2016].
Exhibit 2125: Chen et al., U.S. Appl. No. 61/734,256, filed Dec. 18, 2013. [Document Filing Date: Aug. 15, 2016].
Exhibit 2126: Jinek et al., RNA-programmed genome editing in human cells, eLife (2013) (html version with reviewer comments). [Document Filing Date: Aug. 15, 2016].
Exhibit 2127: Supplemental Data to Jinek et al., RNA-programmed genome editing in human cells, eLife (2013). [Document Filing Date: Aug. 15, 2016].
Exhibit 2128: Wernig et al, WO 2011/091048, filed Jan. 19. 2011. [Document Filing Date: Aug. 15, 2016].

(56) References Cited

OTHER PUBLICATIONS

Exhibit 2201: Ahuja et al., SV40 large T antigen targets multiple cellular pathways to elicit cellular transformation, 24 Oncogene 7729-7745 (2005). [Document Filing Date: May 23, 2016].
Exhibit 2202: Barrangou, RNA-mediated programmable DNA cleavage, 30 Nature Biotechnology 836-838 (2012). [Document Filing Date: May 23, 2016].
Exhibit 2203: Brothers et al., Unexpected Effects of Epitope and Chimeric Tags on Gonadotropin-Releasing Hormone Receptors: Implications for Understanding the Molecular Etiology of Hypogonadotropic Hypogonadism, 88 J. Clinical Endocrinology & Metabolism 6107 (2003). [Document Filing Dale: May 23, 2016].
Exhibit 2204: Brzostek-Racine et al., The DNA Damage Response Induces IFN, 187 J. Immunology 5336-5345 (2011). [Document Filing Date: May 23, 2016].
Exhibit 2205: Cady et al., The CRISPR/Cas Adaptive Immune System of Pseudomonas aeruginosa Mediates Resistance to Naturally Occurring and Engineered Phages, 194 J. Bacteriology 5728-5738 (2012). [Document Filing Date: May 23, 2016].
Exhibit 2207: College of Chemistry, University of California, Berkeley, 9 Catalyst 1-32 (Spring/Summer 2014). [Document Filing Date: May 23, 2016].
Exhibit 2208: Coppoolse et al., Cre recombinase expression can result in phenotypic aberrations in plants, 51 Plant Molecular Biology 263-279 (2003). [Document Filing Date: May 23, 2016].
Exhibit 2209: Elbashir et al., Duplexes of 21-nucleotide RNAs mediate RNA interference in cultured mammalian cells, 411 Nature 494-498 (2001). [Document Filing Date: May 23, 2016].
Exhibit 2211: Fonfara et al., Phylogeny of Cas9 determines functional exchangeability of dual-RNA and Cas9 among ortholcgous type II CRISPR-Cas systems, 42 Nucleic Acids Res. 2577-2590 (2013) and Supplementary Materials. [Document Filing Date: May 23, 2016].
Exhibit 2212: Godwin et al., Spontaneous and restriction enzyme-induced chromosomal recombination in mammalian cells, 91 Proc. Nat'l Acad. Sci. USA 12554-12558 (1994). [Document Filing Date: May 23, 2016].
Exhibit 2213: Grens, Enzyme Improves CRISPR A smaller Cas9 protein enables in vivo genome engineering via viral vectors, The Scientist (Apr. 1, 2015), http://www.the-scientist.com//?articles.view/articleNo/42580/title/Enzyme-Improves-CRISPR/. [Document Filing Date: May 23, 2016].
Exhibit 2214: Guschin et al., A rapid and general assay for monitoring endogenous gene modification, 649 Methods Molecular Biology 247-256 (2010). [Document Filing Date: May 23, 2016].
Exhibit 2215: Heidmann and Lehner, Reduction of Cre recombinase toxicity in proliferating *Drosophila* cells by estrogen-dependent activity regulation, 211 Dev. Genes & Evolution 458-465 (2001). [Document Filing Date: May 23, 2016].
Exhibit 2216: Huang et al., Sensitivity and selectivity of the DNA damage sensor responsible for activating p53-dependent G1 arrest, 93 Proc. Nat'l Acad. Sci. USA 4827-4832 (1996). [Document Filing Date: May 23, 2016].
Exhibit 2217: Huerfano et al., Nucleofection of Expression Vectors Induces a Robust Interferon Response and Inhibition of Cell Proliferation, 32 DNA & Cell Biology 467-479 (2013). [Document Filing Date: May 23, 2016].
Exhibit 2218: Jenuwein et al., The immunoglobulin mu enhancer core establishes local factor access in nuclear chromatin independent of transcriptional stimulation. 7 Genes & Dev. 2016-2032 (1993). [Document Filing Date: May 23, 2016].
Exhibit 2219: Karpala et al., Immune responses to dsRNA: Implications for gene silencing technologies, 83 Immunology & Cell Biology 211-216 (2005). [Document Filing Date: May 23, 2016].
Exhibit 2220: Khanna and Jackson, DNA double-strand breaks: signaling, repair and the cancer connection, 27 Nature Genetics 247-254 (2001). [Document Filing Date: May 23, 2016].
Exhibit 2221: Koseki et al., Factors governing the activity in vivo of ribozymes transcribed by RNA polymerase III, 73 J. Virology 1868-1877 (1999). [Document Filing Date: May 23, 2016].

Exhibit 2223: Link et al., Engineering ligand-responsive gene-control elements: lessons learned from natural riboswitches, 16 Gene Therapy 1189-1201 (2009). [Document Filing Date: May 23, 2016].
Exhibit 2224: Loonstra et al., Growth inhibition and DNA damage induced by Cre recombinase in mammalian cells, 98 Proc. Nat'l Acad. Sci. USA 9209-9214 (2001). [Document Filing Date: May 23, 2016].
Exhibit 2225: McCall et al., Probes of chromatin accessibility in the *Drosophila* bithorax complex respond differently to Polycomb-mediated repression, 15 EMBO J. 569-580 (1996). [Document Filing Date: May 23, 2016].
Exhibit 2226: Mosberg et al., Improving lambda red genome engineering in *Escherichia coli* via rational removal of endogenous nucleases, 7 PLos ONE e44638 (2012). [Document Filing Date: May 23, 2016].
Exhibit 2227: Nishimasu et al., Crystal structure of Cas9 in complex with guide RNA and target DNA, 156 Cell 935-949 (2014). [Document Filing Date: May 23, 2016].
Exhibit 2228: Nishimasu et al., Crystal Structure of *Staphylococcus aureus* Cas9, 162 Cell 1113-1126 (2015). [Document Filing Date: May 23, 2016].
Exhibit 2229: O'Neill el al., Nucleosome arrays inhibit both initiation and elongation of transcripts by bacteriophage T7 RNA polymerase, 223 J. Molecular Biology 67-78 (1992). [Document Filing Date: May 23, 2016].
Exhibit 2230: Pandika, Rising Stars: Jennifer Doudna, CRISPR Code Killer, OZY (Jan. 7, 2014), http://www.ozy.com/rising-stars/jennifer-doudna-crispr-code-killer/4690. [Document Filing Date: May 23, 2016].
Exhibit 2231: Pennisi, The CRISPR Craze, 341 Science 833-836 (2013). [Document Filing Date: May 23, 2016].
Exhibit 2232: Perez et al., Establishment of HIV-1 resistance in CD4+ T cells by genome editing using zinc-finger nucleases, 26 Nature Biotechnology 808-816 (2008). [Document Filing Date: May 23, 2016].
Exhibit 2233: Ran et al., In vivo genome editing using *Staphylococcus aureus* Cas9, 520 Nature 186-191 (2015). [Document Filing Date: May 23, 2016].
Exhibit 2234: Sawitzke et al., Recombineering: in vivo genetic engineering in *E. coli, S. enterica*, and beyond, 421 Methods in Enzymology 171-199 (2007). [Document Filing Date: May 23, 2016].
Exhibit 2235: Schmidt et al., Illegitimate Cre-dependent chromosome rearrangements in transgenic mouse spermatids, 97 Proc. Nat'l Acad. Sci. USA 13702-13707 (2000). [Document Filing Date: May 23, 2016].
Exhibit 2236: Schultz et al., The interferon system of non-mammalian vertebrates, 28 Developmental & Comparative Immunology 466-508 (2004). [Document Filing Date: May 23, 2016].
Exhibit 2237: Semenova et al., Interference by clustered regularly interspaced short palindromic repeat (CRISPR) RNA is governed by a seed sequence, Proc. Nat'l Acad. Sci. USA 10098-101003 (2011). [Document Filing Date: May 23, 2016].
Exhibit 2238: Song et al., Cautionary Tail: The Presence of an N-Terminal Tag on Dynein Light-Chain Roadblock/LC7 Affects Its Interaction with a Functional Partner, 14 Protein & Peptide Letters 265-268 (2007). [Document Filing Date: May 23, 2016].
Exhibit 2239: Turner et al., Carboxyl-terminal Vesicular Stomatitis Virus G Protein-tagged Intestinal Na+-dependent Glucose Cotransporter (SGLT1), 271 J. Biological Chemistry 7738-7744 (1996). [Document Filing Date: May 23, 2016].
Exhibit 2240: Wirtz et al., Regulated processive transcription of chromatin by T7 RNA polymerase in Trypanosoma brucei, 26 Nucleic Acids Res. 4626-4634 (1998). [Document Filing Date: May 23, 2016].
Exhibit 2241: Zhang et al., Potency of catecholamines and other l-tyrosine derivatives at the cloned mouse adrenergic receptors, 47 Neuropharmacology 438-449 (2004). [Document Filing Date: May 23, 2016].
Exhibit 2242: Goldberg, Protein degradation and protection against misfolded or damaged proteins, 426 Nature 895-899 (2003). [Document Filing Date: May 23, 2016].

(56) References Cited

OTHER PUBLICATIONS

Exhibit 2243: Barrangou et al., CRISPR-Cas systems: Prokaryotes upgrade to adaptive immunity, 54 Molecular Cell 234-244 (2014). [Document Filing Date: May 23, 2016].
Exhibit 2244: Bolotin et al., Clustered regularly interspaced short palindrome repeats (CRISPRs) have spacers of extrachromosomal origin, 151 Microbiology 2551-2561 (2005). [Document Filing Date: May 23, 2016].
Exhibit 2245: Brouns et al., Small CRISPR RNAs Guide Antiviral Defense in Prokaryotes, 321 Science 960-964 (2008). [Document Filing Date: May 23, 2016].
Exhibit 2246: Deveau et al., Phage Response to CRISPR-Encoded Resistance in *Streptococcus thermophiles*, 190 J. Bacteriology 1390-1400 (2008). [Document Filing Date: May 23, 2016].
Exhibit 2247: Hale et al. RNA-guided RNA cleavage by a CRISPR RNA-Cas protein complex, 139 Cell 945-956 (2009). [Document Filing Date: May 23, 2016].
Exhibit 2248: Horvath et al., Diversity, Activity, and Evolution of CRISPR Loci in *Streptococcus thermophiles*, 190 J. Bacteriology 1401-1412 (2008). [Document Filing Date: May 23, 2016].
Exhibit 2249: Horvath et al., RNA-guided genome editing á la carte, 23 Cell Res. 733-734 (2013). [Document Filing Date: May 23, 2016].
Exhibit 2250: Ishino et al., Nucleotide sequence of the iap gene, responsible for alkaline phosphatase isozyme conversion in *Escherichia coli*, and identification of the gene product, 169 J. Bacteriology 5429-5433 (1987). [Document Filing Date: May 23, 2016].
Exhibit 2251: Jansen et al., Identification of genes that are associated with DNA repeats in prokaryotes, 43 Molecular Microbiology 1565-1575 (2002). [Document Filing Date: May 23, 2016].
Exhibit 2252: Makarova et al., A putative RNA-interference-based immune system in prokaryotes: computational analysis of the predicted enzymatic machinery, functional analogies with eukaryotic RNAi, and hypothetical mechanisms of action, 1 Biology Direct 7 (2006). [Document Filing Date: May 23, 2016].
Exhibit 2253: Mangold et al., Synthesis of group A streptococcal virulence factors is controlled by a regulatory RNA molecule, 53 Molecular Microbiology 1515-1527 (2004). [Document Filing Date: May 23, 2016].
Exhibit 2254: Mojica et al Transcription at different salinities of Haloferax mediterranei sequences adjacent to partially modified PstI sites, 9 Molecular Microbiology 613-621 (1993). [Document Filing Date: May 23, 2016].
Exhibit 2255: Mojica et al. Discovery and Seminal Developments in the CRISPR Field, CRISPR-Cas Systems, p. 1-31 (Barrangou et al. eds., 2012). [Document Filing Date: May 23, 2016].
Exhibit 2256: Pourcel et al. CRISPR elements in Yersinia pestis acquire new repeats by preferential uptake of bacteriophage DNA, and provide additional tools for evolutionary studies, 151 Microbiology 653-663 (2005). [Document Filing Date: May 23, 2016].
Exhibit 2257: Sorek et al. CRISPR—a widespread system that provides acquired resistance against phages in bacteria and archaea, 6 Nature Reviews Microbiology 181-186 (2008). [Document Filing Date: May 23, 2016].
Exhibit 2258: Mali et al., RNA-Guided Human Genome Engineering via Cas9, 339 Science 823-826 (2013) and Supplementary Materials. [Document Filing Date: May 23, 2016].
Exhibit 2259: Sanders, Cheap and easy technique to snip DNA could revolutionize gene therapy, Berkeley News (Jan. 7, 2013), http://news.berkeley.edu/2013/01/07/cheap-and-easy-technique-to-snip-dna-could-revolutionize-gene-therapy/. [Document Filing Date: May 23, 2016].
Exhibit 2260: Romani and Maguire, Hormonal regulation of Mg2+ transport and homeostasis in eukaryotic cells, 15 Biometals 271-283 (2002). [Document Filing Date: May 23, 2016].
Exhibit 2261: Mastrioanni et al., Group II Intron-Based Gene Targeting Reactions in Eukaryotes, 3 PLoS ONE e3121 (2008). [Document Filing Date: May 23, 2016].

Exhibit 2262: Lander, The Heroes of CRISPR, 164 Cell 18 (2016). [Document Filing Date: Aug. 15, 2016].
Exhibit 2263: Karberg et al., Group II introns as controllable gene targeting vectors for genetic manipulation of bacteria, 19 Nature Biotechnology 1162 (2001). [Document Filing Date: Aug. 15, 2016].
Exhibit 2264: Smith et al., Efficient and Allele-Specific Genome Editing of Disease Loci in Human iPSCs, 23 Molecular Therapy 570 (2015). [Document Filing Date: Aug. 15, 2016].
Exhibit 2265: Chandrasegaran & Carroll, Origins of Programmable Nucleases for Genome Engineering, 428 J. Molecular Biology 963 (2016). [Document Filing Date: Aug. 15, 2016].
Exhibit 2266: Corrigan-Curay et al., Genome Editing Technologies: Defining a Path to Clinic, 23 Molecular Therapy 796 (2015). [Document Filing Date: Aug. 15, 2016].
Exhibit 2267: Cho et al., Heritable Gene Knockout in Caenorhabditis elegans by Direct Injection of Cas9-sgRNA Ribonucleoproteins. 195 Genetics 1177 (2013). [Document Filing Date: Aug. 15, 2016].
Exhibit 2268: Aaagard et al., RNAi Therapeutics: Principles, Prospects and Challenges, 59 Adv. Drug Delivery Rev. 75-86 (2007). [Document Filing Date: Aug. 15, 2016].
Exhibit 2269: Cate et al., Crystal structure of a group I ribozyme domain: principles of RNA packaging, 273 Science 1676-1685 (1996). [Document Filing Date: Aug. 15, 2016].
Exhibit 2270: Costa et al., Rules for RNA recognition of GNRA tetraloops deduced by in vitro selection: comparison with in vivo evolution, 16 EMBO J. 289-3302 (1997). [Document Filing Date: Aug. 15, 2016].
Exhibit 2271: Daigle et al., Nuclear pore complexes form immobile networks and have a very low turnover in live mammalian cells, 154 J. Cell Biol. 74-84 (2001). [Document Filing Date: Aug. 15, 2016].
Exhibit 2272: Ferré-D'-Amaré et al., A General Module for RNA Crystallization, 279 J. Molecular Biology 621-631 (1998). [Document Filing Date: Aug. 15, 2016].
Exhibit 2273: Freier et al., Improved free-energy parameters for predictions of RNA duplex stability, 83 Proc. Natl. Acad. Sci. USA 9373-9377 (1986). [Document Filing Date: Aug. 15, 2016].
Exhibit 2274: Guo et al. Group II Introns Designed to Insert into Therapeutically Relevant DNA Target Sites in Human Cells, 289 Science 452-457 (2000). [Document Filing Date: Aug. 15, 2016].
Exhibit 2275: Horvath et al., Comparative analysis of CRISPR loci in lactic acid bacteria genomes, 131 Int'l J. Food Microbiology 62-70 (2009). [Document Filing Date: Aug. 15, 2016].
Exhibit 2276: Jaeger et al. TectoRNA: modular assembly units for the construction of RNA nano-objects, 29 Nucleic Acids Res. 455-463 (2001). [Document Filing Date: Aug. 15, 2016].
Exhibit 2277: Jore et al. Structural basis for CRISPR RNA-guided DNA recognition by Cascade, 18 Nature Structural & Molecular Biology 529-537 (2011). [Document Filing Date: Aug. 15, 2016].
Exhibit 2278: Lesnik et al., Relative Thermodynamic Stability of DNA, RNA, and DNA:RNA Hybrid Duplexes: Relationship with Base Composition and Structure, 34 Biochemistry 10807-10815 (1995). [Document Filing Date: Aug. 15, 2016].
Exhibit 2279: Mathews, Revolutions in RNA Secondary Structure Prediction, 359 J. Molecular Biology 526- 532 (2006). [Document Filing Date: Aug. 15, 2016].
Exhibit 2280: Molinaro et al., Use of ultrastable UNCG tetraloop hairpins to fold RNA structures: thermodynamic and spectroscopic applications, 23 Nucleic Acids Res. 3056-3063 (1995). [Document Filing Date: Aug. 15, 2016].
Exhibit 2281: Moore et al., Short Hairpin RNA (shRNA): Design, Delivery, and Assessment of Gene Knockdown, 629 Methods Molecular Biology 141-158 (2010). [Document Filing Date: Aug. 15, 2016].
Exhibit 2282: Peebles et al., A self-splicing RNA excises an intron lariat, 44 Cell 213-223 (1986). [Document Filing Date: Aug. 15, 2016].
Exhibit 2283: Soukup et al. Design of allosteric hammerhead ribozymes activated by ligand-induced structure stabilization, 7 Structure 783-791 (1999). [Document Filing Date: Aug. 15, 2016].

(56) References Cited

OTHER PUBLICATIONS

Exhibit 2284: Sternberg et al., DNA interrogation by the CRISPR RNA-guided endonuclease Cas9, 507 Nature 62-67 (2014). [Document Filing Date: Aug. 15, 2016].
Exhibit 2285: Tinoco et al., Estimation of secondary structure in ribonucleic acids, 230 Nature 362-367 (1971). [Document Filing Date: Aug. 15, 2016].
Exhibit 2286: Yu et al., RNA interference by expression of short-interfering RNAs and hairpin RNAs in mammalian cells, 99 Proc. Nat'l Acad. Sci. USA 6047-6052 (2002). [Document Filing Date: Aug. 15, 2016].
Exhibit 2287: Zhong et al., Targeted and random bacterial gene disruption using a group II intron (targetron) vector containing a retrotransposition-activated selectable marker, 31 Nucleic Acids Res. 1656-1664 (2003). [Document Filing Date: Aug. 15, 2016].
Exhibit 2288: Hsu et al., DNA targeting specificity of RNA-guided Cas9 nucleases, 11 Nature Biotechnology 827-834 (2013). [Document Filing Date: Aug. 15, 2016].
Exhibit 2289: Qui et al., Mutation detection using Surveyor™ nuclease, 36 BioTechniques 702-707 (2004). [Document Filing Date: Aug. 15, 2016].
Exhibit 2290: Max E. Perutz Laboratories, Programmable RNA Complex Could Speed Genome Editing in the Lab (Jun. 28, 2012), https://www.mfpl.ac.at/about-us/news/article/news-detail/programmable-rna-complex-could-speed-genome-editing-in-the-lab.html. [Document Filing Date: Aug. 15, 2016].
Exhibit 2291: Howard Hughes Medical Inst., Programmable RNA Complex Could Speed Genome Editing in the Lab (Jun. 28, 2012), http://www.hhmi.org/news/programmable-rna-complex-could-speed-genome-editing-lab. [Document Filing Date: Aug. 15, 2016].
Exhibit 2292: Klosterman et al., There-dimensional motifs from the SCOR, structural classification of RNA database: extruded strands, base triples, tetraloops and U-turns, 32 Nucleic Acids Res. 2342-2352 (2004). [Document Filing Date: Aug. 15, 2016].
Exhibit 2293: Rath et al., The CRISPR-Cas immune system: Biology, mechanisms and applications, 117 Biochimie 119-128 (2015). [Document Filing Date: Aug. 15, 2016].
Exhibit 2294: Sashital et al., Mechanism for Foreign DNA Selection in a Bacterial Adaptive Immune System, 46 Molecular Cell 606-615 (2012). [Document Filing Date: Aug. 15, 2016].
Exhibit 2295: Woese at al., Architecture of ribosomal RNA: Constraints on the sequence of "tetra-loops", 87 Proc. Nat'l Acad. Sci. USA 8467-8471 (1990). [Document Filing Date: Aug. 15, 2016].
Exhibit 2296: Zucker, Mfold web server for nucleic acid folding and hybridization prediction, 31 Nucleic Acids Res. 3406-3415 (2003). [Document Filing Date: Aug. 15, 2016].
Exhibit 2297: Fritz et al., Direct Vpr-Vpr interaction in cells monitored by two photon fluorescence correlation spectroscopy and fluorescence lifetime imaging, 5 Retrovirology (2008). [Document Filing Date: Aug. 15, 2016].
Exhibit 2298: Leenay et al., Identifying and Visualizing Functional PAM Diversity across CRISPR-Cas Systems, 62 Molecular Cell 137-147 (2016). [Document Filing Date: Aug. 15, 2016].
Exhibit 2299: van der Ploeg, Analysis of CRISPR in *Streptococcus mutans* suggests frequent occurrence of acquired immunity against infection by M102-like bacteriophages, 155 Microbiology 1966-1976 (2009). [Document Filing Date: Aug. 15, 2016].
Exhibit 2300: Karvelis et al., Rapid characterization of CRISPR-Cas9 protospacer adjacent motif sequence elements, 16 Genome Biology 1-13 (2015). [Document Filing Date: Aug. 15, 2016].
Exhibit 2301: Polisky et al., Specificity of substrate recognition by the EcoRI restriction endonuclease, 72 Proc. Nat'l Acad. Sci. USA 3310-3314 (1975). [Document Filing Date: Aug. 15, 2016].
Exhibit 2302: Wei et al., The Fidelity Index provides a systematic quantitation of star activity of DNA restriction endonucleases, 36 Nucleic Acids Res. 1-10 (2008). [Document Filing Date: Aug. 15, 2016].
Exhibit 2303: Anders et al., Structural Plasticity of PAM-dependent target DNA recognition by the Cas9 endonuclease, 513 Nature 569-573 (2016). [Document Filing Date: Aug. 15, 2016].

Exhibit 2304: Nagy, Cre Recombinase: The Universal Reagent for Genome Tailoring, 26 Genesis 99-109 (2000). [Document Filing Date: Sep. 28, 2016].
Exhibit 2305: Orillard et al., Biochemical and Cellular Characterization of Helicobacter pylori RecA, a Protein with High-Level Constitutive Expression, 193 J. Bacteriology 6490-6497 (2011). [Document Filing Date: Sep. 28, 2016].
Exhibit 2306: Zhou et al., Mammalian MagT1 and TUSC3 are required for cellular magnesium uptake and vertebrate embryonic development, 106 Proc. Nat'l Acad. Sci. USA 15750-15755 (2009). [Document Filing Date: Sep. 28, 2016].
Exhibit 2307: Fatholahi et al., Relationship between Total and Free Cellular Mg2+ during Metabolic Stimulation of Rat Cardiac Myocytes and Perfused Hearts, 374 Archives of Biochemistry and Biophysics 395-401 (2000). [Document Filing Date: Sep. 28, 2016].
Exhibit 2308: Chylinski el al., The tracrRNA and Cas9 families of type II CRISPR-Cas immunity systems, 10 RNA Biology 726-737 (2013). [Document Filing Date: Sep. 28, 2016].
Exhibit 2309: U.S. Appl. No. 13/353,662, filed Jan. 19, 2012. [Document Filing Date: Sep. 28, 2016].
Exhibit 2310: Kim et al., U.S. Appl. No. 13/768,798, filed Feb. 15, 2013. [Document Filing Date: Sep. 28, 2016].
Exhibit 2311: Reyon et al., Current Protocols in molecular Biology Engineering Designer Transcription Activator-Like Effector Nucleases (TALENs), Current Protocols in Molecular Biology 1-17. [Document Filing Date: Sep. 28, 2016].
Exhibit 2312: Email from Feng Zhang to Shuailiang Lin dated Oct. 24, 2011. [Document Filing Date: Sep. 28, 2016].
Exhibit 2313: Marked up copy of Ex. 1534, Figure 1 from Sep. 16, 2016, deposition of Dr. Carol Greider. [Document Filing Date: Sep. 28, 2016].
Exhibit 2314: Sanders, CRISPR-Cas9 gene editing: check three times, cut once, Berkeley News (Nov. 12, 2015). [Document Filing Date: Sep. 28, 2016].
Exhibit 2315: UniProtKB of Type-2 restriction enzyme EcoRI. [Document Filing Date: Sep. 28, 2016].
Exhibit 2316: Distribution of restriction sites in the human genome. [Document Filing Date: Sep. 28, 2016].
Exhibit 2401: Addgene: The nonprofit plasmid repository, Description of pX330-U6-Chimeric_BB-CBh-hSpCas9 (Plasmid # 42230), https://www.addgene.org/42230/. [Document Filing Date. May 23, 2016].
Exhibit 2402: Berkeley Lab webpage of Dr. James H. Doudna Cate, http://www.pbd.lbl.gov/scientists/jamie-cate/. [Document Filing Date: May 23, 2016].
Exhibit 2403: Google Trends, https://www.google.com/trends/explore#q=CRISPR%2C%20Cas9&cmpt=q&tz=Etc%2FGMT%2B4. [Document Filing Date: May 23, 2016].
Exhibit 2404: Interference 106,048, Count I. [Document Filing Date: Aug. 15, 2016].
Exhibit 2405: Interference 106,048, Paper 43, Second Replacement Broad Clean Copies of Claims. [Document Filing Date: Aug. 15, 2016].
Exhibit 2406: Declaration of Brayn R. Cullen in U.S. Appl. No. 14/685,510, executed Jun. 24, 2016. [Document Filing Date: Aug. 15, 2016].
Exhibit 2407: Sequence Data compiled from: Cho et al., Heritable Gene Knockout in Caenorhabditis elegans by Direct Injection of Cas0-sgRNA Ribonucleoproteins, 195 Genetics 1177 (2013); and Cho et al., Targeted genome engineering in human cells with the Cas9 RNA-guided endonuclease, 31 Nature Biotechnology 230 (2013). [Document Filing Date: Aug. 15, 2016].
Exhibit 2408: Schedule of FASEB Conference on Genome Engineering held in Lucca, Italy from Sep. 2-7, 2012. [Document Filing Date: Aug. 15, 2016].
Exhibit 2409: An analysis of Figure 3C of Doudna P1, Deltcheva Supplementary Figure 2A, and NCBI BLAST results of the sequences of Figure 3C of Doudna P1. [Document Filing Date: Aug. 15, 2016].
Exhibit 2410: Wageninen meeting program, Oct. 2010. [Document Filing Date: Aug. 15, 2016].
Exhibit 2411: U.S. Appl. No. 14/704,551 Excerpt, NIH grant application. [Document Filing Date: Aug. 15, 2016].

(56) References Cited

OTHER PUBLICATIONS

Exhibit 2412: U.S. Appl. No. 14/054,414 Excerpt, Cong notebook. [Document Filing Date: Aug. 15, 2016].
Exhibit 2413: U.S. Appl. No. 12/565,589 Excerpt. [Document Filing Date: Aug. 15, 2016].
Exhibit 2414: U.S. Appl. No. 14/685,516 Excerpt. [Document Filing Date: Aug. 15, 2016].
Exhibit 2415: RNA Institute College of Arts and Sciences, The mfold Web Server, University at Albany, State University of New York, http://unafold.rna.albany.edu/?q=mfold. [Document Filing Date: Aug. 15, 2016].
Exhibit 2416: Rousseau et al., CRISPI: a CRISPR interactive database, Bioinformatics, http://m.bioinformatics.oxfordjournals.org/content/25/24/3317.full. [Document Filing Date: Aug. 15, 2016].
Exhibit 2417: Marraffini, The CRISPR-Cas system of *Streptococcus pyogenes*: function and applications (2016). [Document Filing Date: Aug. 15, 2016].
Exhibit 2418: Integrated DNA Technologies, User Guide, Surveyor Mutation Detection Kit for Standard Gel Electrophoresis. [Document Filing Date: Aug. 15, 2016].
Exhibit 2419: Gairdner, 2016 Canada Gairdner Awards Honour CRISPR-Cas Researchers and HIV/Aids Leaders. [Document Filing Date: Aug. 15, 2016].
Exhibit 2420: Science Magazine 2014 Media Kit. [Document Filing Date: Aug. 15, 2016].
Exhibit 2421: BioResearch, Lonza, Amaxa 4D-Nucleofector Protocol for K562 [ATCC]. [Document Filing Date: Aug. 15, 2016].
Exhibit 2422: U.S. Appl. No. 14/685,510 File History Excerpt. [Document Filing Date: Aug. 15, 2016].
Exhibit 2423: Edge, Conversation: Life, The Augmented Human Being: A Conversation with George Church (Mar. 30, 2013), https://www.edge.org/conversation/george_church-the-augmented-human-being. [Document Filing Date: Aug. 15, 2016].
Exhibit 2424: U.S. Appl. No. 14/183,486 File History Excerpt. [Document Filing Date: Aug. 15, 2016].
Exhibit 2425: Marked up version of Ex. 1032, Figure 4, from Sep. 13, 2016, deposition of Dr. Ronald Breaker. [Document Filing Date: Sep. 28, 2016].
Exhibit 2426: NCBI GenBank search results for "CRISPR-associated protein Cas9" with Dec. 12, 2012 date filter. [Document Filing Date: Sep. 28, 2016].
Exhibit 2427: NCBI GenBank search results for "CRISPR-associated protein Cas9" with Dec. 12, 2012 date filler and 1368 amino acid size filter. [Document Filing Date: Sep. 28, 2016].
Exhibit 2428: NCBI GenBank search results for "CRISPR-associated protein Cas9" with Dec. 12, 2012 date filter and 1063 amino acid size filter. [Document Filing Date: Sep. 28, 2016].
Exhibit 2429: Ma et al., CRISPR-Cas9 nuclear dynamics and target recognition in living cells, J. Cell Biology 1-13 (2016). [Document Filing Date: Sep. 28, 2016].
Exhibit 2430: Broad Objections to UC Opposition Exhibits, filed Aug. 22, 2016. [Document Filing Date: Oct. 11, 2016].
Exhibit 2431: Broad Objections to UC Reply Exhibits. [Document Filing Date: Oct. 11, 2016].
Broad Misc Motion 1 [Document Filing Date: Mar. 2, 2016].
Senior Party Miscellaneous Motion 1 [Document Filing Date: Mar. 30, 2016].
Senior Party Miscellaneous Motion 2 [Document Filing Date: Mar. 31, 2016].
UC et al. Substantive Motion 3 [Document Filing Date: May 23, 2016].
UC et al. Substantive Motion 4 [Document Filing Date: May 23, 2016].
Broad et al Substantive Motion 3 [Document Filing Date: May 23, 2016].
Broad et al Substantive Motion 5 [Document Filing Date: May 23, 2016].
Broad et al Substantive Motion 2 [Document Filing Date: May 23, 2016].
Broad et al. Contingent Responsive Motion 6 [Document Filing Date: Jun. 22, 2016].
Broad et al Unopposed Miscellaneous Motion 7 [Document Filing Date: Jun. 22, 2016].
UC et al. Opposition 2 [Document Filing Date: Aug. 15. 2016].
UC et al. Opposition 3 [Document Filing Date: Aug. 15, 2016].
UC et al. Opposition 6 [Document Filing Date: Aug. 15, 2016].
UC et al. Opposition 5 [Document Filing Date: Aug. 15, 2016].
Broad et al. Opposition 4 [Document Filing Date: Aug. 15, 2016].
Broad et al. Opposition 3 [Document Filing Date: Aug. 15, 2016].
UC et al. Reply 3 [Document Filing Date: Sep. 28, 2016].
UC et al. Reply 4 [Document Filing Date: Sep. 28, 2016].
Broad et al. Reply 2 [Document Filing Date: Sep. 28, 2016].
Broad et al. Reply 3 [Document Filing Date: Sep. 28, 2016].
Broad et al. Reply 5 [Document Filing Date: Sep. 28, 2016].
Broad et al. Reply 6 [Document Filing Date: Sep. 28, 2016].
Broad et al. Miscellaneous Motion 8 (to Exclude Evidence) [Document Filing Date: Oct. 11, 2016].
UC et al. Miscellaneous Motion 5 (to Exclude Evidence) [Document Filing Date: Oct. 11, 2016].
Broad et al. Opposition 5 [Document Filing Date: Oct. 21, 2016].
UC et al. Opposition 8 [Document Filing Date: Oct. 21, 2016].
Broad et al Reply 8 [Document Filing Date: Oct. 28, 2016].
UC et al. Reply 5 [Document Filing Date: Oct. 28, 2016].
Papworth, et al.; "Designer zinc-finger proteins and their applications"; Gene; vol. 366, pp. 27-38 (2006).
Third Party Observations for EP Application No. 13793997.1 (observations filed Dec. 15, 2016).
Third Party Observations for EP Application No. 13793997.1 (observations filed Dec. 16, 2016).
Exam Report for UK Application No. GB1601071.2 (dated Aug. 3, 2016).
Exam Report for UK Application No. GB1601071.2 (dated Dec. 16, 2016).
Third Party Observations for UK Application No. GB1601071.2 (observations filed Dec. 22, 2016).
Exam Report (including response to Dec. 22 third party observations) for UK Application No. GB1601071.2 (dated Jan. 16, 2017).
Third Party Observations for UK Application No. GB1601071.2 (observations filed Jan. 13, 2017).
Exam Report—Letter of Intention to Grant (including response to Dec. 22 third party observations) for UK Application No. GB1601071.2 (dated Jan. 23, 2017).
Letter—Notification of grant for UK Application No. GB1601071.2 (dated Feb. 7, 2017).
Claims granted in UK Application No. GB1601071.2 (Feb. 7, 2017).
Ph.D. Thesis of Doris Veit (Inventoried in main university library Jan. 14, 2009).
Ph.D. Thesis of Karine Gonzales (available online Sep. 13, 2011, inventoried in main university library Dec. 27, 2011).
Chylinski et al., "Identification and analysis of function of small RNA binding proteins in *Streptococcus pyogenes*", Internal retreat with a few outside speakers (2010) (Poster) (retreat began on Mar. 8, 2010).
Chylinski et al., "Proteins involved in sRNA-mediated regulation in *Streptococcus pyogenes*", hearing of the RNA PhD program in front of Austrian science funding agency (FWF) representatives and some external reviewers (2010) (Poster) (Mar. 18, 2010).
Chylinski et al., "tracrRNA—atypical family of small RNAs co-evolving with CRISPR bacterial immunity system", Internal retreat with a few outside speakers (2012) (Poster) (retreat began on May 10, 2012).
Decision on Motions—Interference 106,048 (Feb. 15, 2017).
PowerPoint slides entitled "Interview 9 Sep. 2015." (Filed in U.S. Appl. No. 14/105,035, on Oct. 2, 2015).
Press release from Umea University related to Deltcheva 2011 article (Mar. 30, 2011).
Charpentier, et al., "Trans RNA-mediated CRISPR RNA maturation is essential in host immunity against invading genomes" CRISPR Meeting, Wageningen, The Netherlands (2010) (Abstract) (conference began on Oct. 21, 2010).

(56) References Cited

OTHER PUBLICATIONS

Decision to grant EP Application No. 13793997.1 (dated Apr. 13, 2017).
Claims as allowed in EP Application No. 13793997.1 (Sep. 22, 2016).
Janssen et al., Mouse models of K-ras-initiated carcionogenesis, Biochim Biophys Acta. Nov. 25, 2005;1756(2):145-54.
Aram Akopian, "Chimeric recombinases with designed DNA sequence recognition", Proc Natl Acad Sci U S A., Jul. 22, 2003, 8688-91, 100(15) [Epub Jul. 1, 2003].
Roger R. Beerli, "Toward controlling gene expression at will: specific regulation of the erbB-2/HER-2 promoter by using polydactyl zinc finger proteins constructed from modular building blocks", Proc Natl Acad Sci U S A., Dec. 8, 1998, 14628-33, 95(25).
Brian Chaikind, "A programmable Cas9-serine recombinase fusion protein that operates on DNA sequences in mammalian cells", Nucleic Acids Res., Nov. 16, 2016, 9758-9770, 44(20) [Epub Aug. 11, 2016].
Samrat Roy Choudhury, "CRISPR-dCas9 mediated TET1 targeting for selective DNA demethylation at BRCA1 promoter", Oncotarget., Jul. 19, 2016, 46545-46556, 7(29).
Luke A. Gilbert, "CRISPR-mediated modular RNA-guided regulation of transcription in eukaryotes", Cell., Jul. 18, 2013, 442-51,154(2). [Epub Jul. 11, 2013].
Russell M. Gordley, "Synthesis of programmable integrases", Proc Natl Acad Sci U S A., Mar. 31, 2009, 5053-8,106(13) [Epub Mar. 12, 2009].
John P. Guilinger, "Fusion of catalytically inactive Cas9 to FokI nuclease improves the specificity of genome modification", Nat Biotechnol., Jun. 2014, 577-582, 32(6). [Epub Apr. 25, 2014].
Satoshi Hara, "Generation of mutant mice via the CRISPR/Cas9 system using FokI-dCas9", Sci Rep., Jun. 9, 2015,1-9,11221.
Isaac B. Hilton, "Epigenome editing by a CRISPR-Cas9-based acetyltransferase activates genes from promoters and enhancers", Nat Biotechnol., May 2015, 510-7, 33(5). [Epub Apr. 6, 2015].
Nicola A Kearns, "Functional annotation of native enhancers with a Cas9-histone demethylase fusion", Nat Methods. 2015, 401-403, May;12(5). [Epub Mar. 16, 2015].
Alexis C. Komor, "Programmable editing of a target base in genomic DNA without double-stranded DNA cleavage", Nature., May 19, 2016, 420-4, 533(7603). [Epub Apr. 20, 2016].
X. Shawn Liu, "Editing DNA Methylation in the Mammalian Genome", Cell., Sep. 22, 2016, 233-247, 167(1).
Morgan L Maeder, "CRISPR RNA-guided activation of endogenous human genes", Nat Methods., Oct. 2013, 977-9, 10(10). [Epub Jul. 25, 2013].
Jeffrey G. Mandell, "Zinc Finger Tools: custom DNA-binding domains for transcription factors and nucleases", Nucleic Acids Research, Jul. 1, 2006, pp. W516-W523,vol. 34.
Keiji Nishida, "Targeted nucleotide editing using hybrid prokaryotic and vertebrate adaptive immune systems", Science., Sep. 16, 2016, 1248 (aaf8729-1), 353(6305). [Epub Aug. 4, 2016].
Wataru Nomura, "In vivo site-specific DNA methylation with a designed sequence-enabled DNA methylase", J Am Chem Soc., Jul. 18, 2007, 8676-7, 129(28). [Epub Jun. 21, 2007].
Monika Papworth, "Inhibition of herpes simplex virus 1 gene expression by designer zinc-finger transcription factors", Proc Natl Acad Sci U S A., Feb. 18, 2003, 1621-6, 100(4). [Epub Feb. 6, 2003].
Pablo Perez-Pinera, "RNA-guided gene activation by CRISPR-Cas9-based transcription factors", Nat Methods., Oct. 2013, 973-6, 10(10) [Epub Jul. 25, 2013].
Agnieszka Piatek, "RNA-guided transcriptional regulation in planta via synthetic dCas9-based transcription factors", Plant Biotechnol J., May 2015, 578-89,13(4). [Epub Nov. 14, 2014].
Ashley G. Rivenbark, "Epigenetic reprogramming of cancer cells via targeted DNA methylation", Epigenetics., Apr. 2012, 350-60, 7(4). [Epub Apr. 1, 2012].
Neville E. Sanjana, "A transcription activator-like effector toolbox for genome engineering", Nat Protoc., Jan. 5, 2012, 171-92,7(1).

Andrew W. Snowden, "Gene-specific targeting of H3K9 methylation is sufficient for initiating repression in vivo", Curr Biol., Dec. 23, 2002, 2159-66, 12(24).
Siyuan Tan, "Zinc-finger protein-targeted gene regulation: genomewide single-gene specificity", Proc Natl Acad Sci U S A., Oct. 14, 2003, 11997-2002,100(21) [Epub Sep. 26, 2003].
Wenjie Tan, "Human immunodeficiency virus type 1 incorporated with fusion proteins consisting of integrase and the designed polydactyl zinc finger protein E2C can bias integration of viral DNA into a predetermined chromosomal region in human cells", J Virol., Feb. 2006, 1939-48, 80(4).
Gabriele Varani, "Exceptionally stable nucleic acid hairpins", Annu Rev Biophys Biomol Struct., 1995, pp. 379-404,vol. 24.
Aleksandar Vojta, "Repurposing the CRISPR-Cas9 system for targeted DNA methylation", Nucleic Acids Res., Jul. 8, 2016, 5615-28, 44(12) [Epub Mar. 11, 2016].
Opposition Brief; Appellees; United States Court of Appeals for the Federal Circuit; Appeal No. 2017-1907 (Filed on Oct. 25, 2017).
Reply Brief; Appellants: United States Court of Appeals for the Federal Circuit; Appeal No. 2017-1907 (Filed on Nov. 22, 2017).
Grounds of opposition, Opponent 01: European Patent No. EP2800811 (dated Feb. 9, 2018).
Grounds of opposition, Opponent 02: European Patent No. EP2800811 (dated Feb. 9, 2018).
Grounds of opposition, Opponent 03: European Patent No. EP2800811 (dated Feb. 8, 2018).
Grounds of opposition, Opponent 04: European Patent No. EP2800811 (dated Feb. 9, 2018).
Grounds of opposition, Opponent 05: European Patent No. EP2800811 (dated Feb. 9, 2018).
Grounds of opposition, Opponent 06: European Patent No. EP2800811 (dated Feb. 11, 2018).
Grounds of opposition, Opponent 07: European Patent No. EP2800811 (dated Feb. 12, 2018).
Kunin et al., Genome Biol. 2007;8(4):R61; "Evolutionary conservation of sequence and secondary structures in CRISPR repeats".
Uhlenbeck, Nature. Aug. 16, 1990;346(6285):613-4; "Tetraloops and RNA folding".
Declaration of Dr. Hentze [Feb. 2018].
CV of Dr. Hentze [Feb. 2018].
Hendrix et. al., Q Rev Biophys. Aug. 2005;38(3):221-43. Epub Jul. 3, 2006; "RNA structural motifs: building blocks of a modular biomolecule".
Declaration of Dr. Patton [Feb. 2018].
CV of Dr. Patton [Feb. 2018].
Zimmerly et al., "Group II intron mobility occurs by target DNA-primed reverse transcription"; Cell. Aug. 25, 1995;82(4):545-54.
Yang et al., "Efficient integration of an intron RNA into double-stranded DNA by reverse splicing"; Nature. May 23, 1996;381(6580):332-5.
Sternberg and Hamilton; "Bacteriophage P1 site-specific recombination. I. Recombination between loxP sites"; J Mol Biol. Aug. 25, 1981;150(4):467-86.
Sternberg et al.; "Bacteriophage P1 site-specific recombination. II. Recombination between loxP and the bacterial chromosome"; 1981 J. Mol. Biol.
Anders, C. et al.; "Structural basis of PAM-dependent target DNA recognition by the Cas9 endonuclease"; Nature. Sep. 25, 2014;513(7519):569-73.
Joung, K.; "Building with biological LEGO. Interview by Kristie Nybo"; Biotechniques. Jun. 2012;52(6):351.
Comparison of disclosures; cited by opponent of European Patent No. EP2800811 [Feb. 2018].
Declaration by Dr. Benjamin John Davies [Feb. 2018].
Davies, B et al.; Site specific mutation of the Zic2 locus by microinjection of TALEN mRNA in mouse CD1, C3H and C57BL/6J oocytes; PLoS One. 2013;8(3):e60216,Epub Mar. 28, 2013.
CV of Dr. Benjamin John Davies [Feb. 2018].
Kim, E., et al.; "In vivo genome editing with a small Cas9 orthologue derived from Campylobacter jejuni"; Nat Commun. Feb. 21, 2017;8:14500.

(56) References Cited

OTHER PUBLICATIONS

Xu, Z. et al.; "Accuracy and efficiency define Bxb1 integrase as the best of fifteen candidate serine recombinases for the integration of DNA into the human genome"; BMC Biotechnol. Oct. 20, 2013;13:87.
Robertson, HD. et al.; "Purification and properties of a specific *Escherichia coli* ribonuclease which cleaves a tyrosine transfer ribonucleic acid presursor"; J Biol Chem. Aug. 25, 1972;247(16):5243-51.
Guerrier-Takada, C. et al.; "The RNA moiety of ribonuclease P is the catalytic subunit of the enzyme"; Cell. Dec. 1983;35(3 Pt 2):849-57.
McClain, WH; "Model substrates for an RNA enzyme"; Science. Oct. 23, 1987;238(4826):527-30.
Forster, AC and Altman, S.; "External guide sequences for an RNA enzyme"; Science. Aug. 17, 1990;249(4970):783-6.
Li, Y. et al.; "Targeted cleavage of mRNA in vitro by RNase P from *Escherichia coli*"; Proc Natl Acad Sci U S A. Apr. 15, 1992;89(8):3185-9.
Liu, F. and Altman, S.; "Inhibition of viral gene expression by the catalytic RNA subunit of RNase P from *Escherichia coli*"; Genes Dev. Feb. 15, 1995;9(4):471-80.
Plehn-Dujowich, D. and Altman, S.; "Effective inhibition of influenza virus production in cultured cells by external guide sequences and ribonuclease P"; Proc Natl Acad Sci U S A. Jun. 23, 1998;95(13):7327-32.
Kim, K. and Liu, F.; "Inhibition of gene expression in human cells using RNase P-derived ribozymes and external guide sequences"; Biochim Biophys Acta. Nov.-Dec. 2007;1769(11-12):603-12. Epub Sep. 29, 2007.
Yuan, Y. and Altman, S.; "Selection of guide sequences that direct efficient cleavage of mRNA by human ribonuclease P"; Science. Mar. 4, 1994;263(5151):1269-73.
Kilani, AF et al.; "RNase P ribozymes selected in vitro to cleave a viral mRNA effectively inhibit its expression in cell culture"; J Biol Chem. Apr. 7, 2000;275(14):10611-22.
Zhou, T. et al.; "In vitro selection of external guide sequences for directing RNase P-mediated inhibition of viral gene expression"; J Biol Chem. Aug. 16, 2002;277(33):30112-20. Epub Jun. 5, 2002.
Cox, MM; "The FLP protein of the yeast 2-microns plasmid: expression of a eukaryotic genetic recombination system in *Escherichia coli*"; Proc Natl Acad Sci U S A. Jul. 1983;80(14):4223-7.
Babineau, D. et al., "The FLP protein of the 2-micron plasmid of yeast. Purification of the protein from *Escherichia coli* cells expressing the cloned FLP gene"; J Biol Chem. Oct. 5, 1985;260(22):12313-9.
O'Gorman, et al.; "Recombinase-Mediated Gene Activation and Site-Specific Integration in Mammalian Cells"; Science; vol. 251, No. 4999, pp. 1351-1355 (Mar. 15, 1991).
Buchholz, et al.; "Different thermostabilities of FLP and Cre recombinases: implications for applied site-specific recombination"; Nucleic Acids Research; vol. 24, No. 21, pp. 4256-4262 (1996).
Buchholz, et al.; "Improved properties of FLP recombinase evolved by cycling mutagenesis"; Nature Biotechnology; vol. 16, pp. 657-662 (Jul. 1998).
Rodriguez, et al.,.; "High-efficiency deleter mice show that FLPe is an alternative to Cre-loxP"; Nature Genetics; vol. 25, No. 2, pp. 139-140 (Jun. 2000).
Ma, et al.; "Single-Stranded DNA Cleavage by Divergent CRISPR-Cas9 Enzymes"; Molecular Cell; vol. 60, pp. 398-407 (Nov. 5, 2015).
Davis, et al.; "Role of metal ions in the tetraloop-receptor complex as analyzed by NMR"; RNA; vol. 13, pp. 76-86 (2007).
Graham, et al.; "Resources for the design of CRISPR gene editing experiments"; Genome Biology; vol. 16, No. 260, 21 pages (Nov. 27, 2015).

Weninger, et al.; "A toolbox of endogenous and heterologous nuclear localization sequences for the methylotrophic yeast"; FEMS Yeast Res.; vol. 15, No. 7, 4 pages (2015).
Richter, et al.; "Function and Regulation of Clustered Regularly Interspaced Short Palindromic Repeats (CRISPR)/CRISPR Associated (Cas) Systems"; Viruses; vol. 4, pp. 2291-2311 (2012).
Mei, et al.; "Recent Progress in CRISPR/Cas9 Technology"; Journal of Genetics and Genomics; vol. 43, pp. 63-75 (2016).
Makarova, et al.; "An updated evolutionary classification of CRISPR-Cas systems"; Nature Reviews Microbiology; vol. 13, pp. 722-736 (Nov. 2015) and Supplementary Information; 14 pages (Nov. 2015).
Fonfara, et al.; "Phylogeny of Cas9 determines functional exchangeability of dual-RNA and Cas9 among orthologous type II CRISPR-Cas systems"; Nucleic Acids Research; vol. 42, No. 4, pp. 2577-2590 (2014).
Merten; "Viral Vectors for Gene Therapy, Methods and Protocols"; 455 pages (2011).
Tkachenko, et al.; "Cellular Trajectories of Peptide-Modified Gold Particle Complexes: Comparison of Nuclear Localization Signals and Peptide Transduction Domains"; Bioconjugate Chem; vol. 15, pp. 482-490 (2004).
Foo, et al.; "Mutation of outer-shell residues modulates metal ion co-ordination strength in a metalloenzyme"; Biochem. J.; vol. 429, pp. 313-321 (2010).
Brodkin, et al.; "Prediction of distal residue participation in enzyme catalysis"; Protein Science; vol. 24, pp. 762-778 (2015).
Annexe 1 of letter to EPO from Applicants, [dated Mar. 20, 2015].
EP2800811: Third Party Observation filed by Thomas W. Tolpin on Jan. 6, 2015.
EP2800811: Reply from the Applicant dated Jun. 12, 2015.
EP2800811: Third Party Observation filed by the Broad Institute, Inc., dated Jul. 24, 2015.
EP2800811: Third Party Observation filed by the Broad Institute, Inc., dated Sep. 4, 2015.
EP2800811: Reply from the Applicant dated Mar. 14, 2016.
EP2800811: Third Party Observation filed on Apr. 20, 2016.
EP2800811: Reply from the Applicant dated Sep. 22, 2016.
EP2800811: Third Party Observation filed on Dec. 16, 2016.
Reply from the Applicant in GB 1420270.9; dated Dec. 17, 2015.
Declaration of Dana Carroll filed in GB1420270.9 (dated Apr. 2015).
Third Party Observation filed in GB 1420270.9 [dated Jul. 13, 2015].
Hall, et al.; "Effects of inert volume-excluding macromolecules on protein fiber formation. I. Equilibrium models"; Biophysical Chemistry; vol. 98, pp. 93-104 (2002).
Hall, et al.; "Effects of inert volume-excluding macromolecules on protein fiber formation. II. Kinetic models for nucleated fiber growth"; Biophysical Chemistry; vol. 107, pp. 299-316 (2004).
Martin; "Requirement for GroEL/GroES-Dependent Protein Folding under Nonpermissive Conditions of Macromolecular Crowding"; Biochemistry; vol. 41, pp. 5050-5055 (2002).
Van Den Berg, et al.; "Effects of macromolecular crowding on protein folding and aggregation"; The EMBO Journal; vol. 18, No. 24, pp. 6927-6933 (1999).
Declaration by Prof Lambowitz (dated Oct. 2017).
Concordance Table for declarations (Feb. 2018).
Mohr, et al.; "Rules for DNA target-site recognition by a lactococcal group II intron enable retargeting of the intron to specific DNA sequences"; Genes & Development; vol. 14, pp. 559-573 (2000).
Gryllos, et al.; "The CsrR/CsrS two-component system of group A *Streptococcus* responds to environmental $Mg^{2+}$"; PNAS; vol. 100, No. 7, pp. 4227-4232 (Apr. 1, 2003).
Neef, et al.; "Deletion of a Cation Transporter Promotes Lysis in *Streptococcus pneumoniae*$^{\nabla}$†"; Infection and Immunity; vol. 79, No. 6, pp. 2314-2323 (Jun. 2011).
Declaration by Dr Simons 2015 (dated Dec. 2015).
Declaration by Prof Loring 2017 (dated Oct. 2017).
Declaration by Dr Urnov 2017 (dated Oct. 2017).
Lacasse, EC and Lefebvre, YA; "Nuclear localization signals overlap DNA- or RNA-binding domains in nucleic acid-binding proteins"; Nucleic Acids Res. May 25, 1995;23(10):1647-56.

(56) References Cited

OTHER PUBLICATIONS

Kimchi-Sarfaty, C. et al.; "A "silent" polymorphism in the MDR1 gene changes substrate specificity"; Science. Jan. 26, 2007;315(5811):525-8. Epub Dec. 21, 2006.
Maertens, B. et al.; "Gene optimization mechanisms: a multi-gene study reveals a high success rate of full-length human proteins expressed in *Escherichia coli*"; Protein Sci. Jul. 2010;19(7):1312-26. doi: 10.1002/pro.408.
Mauro, VP and Chappell, SA; "A critical analysis of codon optimization in human therapeutics"; Trends Mol Med. Nov. 2014;20(11):604-13. doi: 10.1016/j.molmed.2014.09.003. Epub Sep. 25, 2014.
Aguirre, AJ et al.; "Genomic Copy Number Dictates a Gene-Independent Cell Response to CRISPR/Cas9 Targeting"; Cancer Discov. Aug. 2016;6(8):914-29. doi: 10.1158/2159-8290.CD-16-0154. Epub Jun. 3, 2016.
Ihry, R et al.; "P53 toxicity is a hurdle to CRISPR/CAS9 screening and engineering in human pluripotent stem cells"; Jul. 26, 2017; https://doi.org/10.1101/168443.
Jiang, W. et al.; "Successful transient expression of Cas9 and single guide RNA genes in Chlamydomonas reinhardtii"; Eukaryot Cell. Nov. 2014;13(11):1465-9. doi: 10.1128/EC.00213-14. Epub Sep. 19, 2014.
Declaration by Prof Bryan Cullen [dated Jun. 2016].
Document filed by opponent to EP2800811 in Feb. 2018: alleged to be Jinek et al. manuscript available as of Jan. 7, 2013.
Art 94(3) EPC Comm [Aug 22, 2017] in EP3071695 (Application No. EP14825102).
Response to R161 in EP3071695 [dated Jan. 5, 2017].
U.S. Appl. No. 61/779,169, filed Jun. 26, 2014, President and Fellows of Harvard College.

\* cited by examiner

Cas9/Csn1 Streptococcus pyogenes motifs

1 MDKKYSIGL<u>D</u>IGTNSV<u>G</u>WAVITDDYKVPSKKLKGLGNTDRHGIKKNLIGALL
FDSGETAEATRLKRTARRRYTRRKNRICYLQEIFSNEMAKVDDSFFHRLEE
SFLVEEDKKHERHPIFGNIVDEVAYHEKYPTIYHLRKKLADSTDKVDLRLIYL
ALAHMIKFRGHFLIEGDLNPDNSDVDKLFIQLVQTYNQLFEENPINASRVDA
KAILSARLSKSRRLENLIAQLPGEKKNGLFGNLIALSLGLTPNFKSNFDLAED
AKLQLSKDTYDDDLDNLLAQIGDQYADLFLAAKNLSDATLLSDILRVNSEITK
APLSASMIKRYDEHHQDLTLLKALVRQQLPEKYKEIFFDQSKNGYAGYIDGG
ASQEEFYKFIKPILEKMDGTEELLAKLNREDLLRKQRTFDNGSIPYQIHLGEL
HAILRRQEDFYPFLKDNREKIEKILTFRIPYYVGPLARGNSRFAWMTRKSEE
TITPWNFEEVVDKGASAQSFIERMTNFDKNLPNEKVLPKHSLLYEYFTVYN
ELTKVKYVTEGMRKPAFLSGEQKKAIVDLLFKTNRKVTVKQLKEDYFKKIEC
FDSVEISGVEDRFNASLGTYHDLLKIIKDKDFLDNEENEDILEDIVLTLTLFED
REMIEERLKTYAHLFDDKVMKQLKRRRYTGWGRLSRKLINGIRDKQSGKTI
LDFLKSDGFANRNFMQLIHDDSLTFKEDIQKAQVSGQGDSLHEHIANLAGS
2 PAIKKGILQTVKVVDELVKVMGRHKPENIV<u>IEMARE</u>NQTTQKGQKNSRERM
KRIEEGI<u>K</u>ELGSDILKEYPVENTQLQNEKLYLYYLQNGRDMYVDQELDINRL
3 SDY<u>DVDHIVPQSFLKDDSIDNKVLTRSDKN</u>RGKSDNVPSEEVVKKMKNYW
RQLLNAKLITQRKFDNLTKAERGGLSELDKVGFIKRQLVETRQITKHVAQILD
4 SRMNTKYDENDKLIREVRVITLKSKLVSDFRKDFQFYKVREINNY<u>HHAHDAY</u>
LNAVVGTALIKKYPKLESEFVYGDYKVYDVRKMIAKSEQEIGKATAKYFFYS
NIMNFFKTEITLANGEIRKRPLIETNGETGEIVWDKGRDFATVRKVLSMPQV
NIVKKTEVQTGGFSKESILPKRNSDKLIARKKDWDPKKYGGFDSPTVAYSVL
VVAKVEKGKSKKLKSVKELLGITIMERSSFEKDPIDFLEAKGYKEVRKDLIIKL
PKYSLFELENGRKRMLASAGELQKGNELALPSKYVNFLYLASHYEKLKGSP
EDNEQKQLFVEQHKHYLDEIIEQISEFSKRVILADANLDKVLSAYNKHRDKPI
REQAENIIHLFTLTNLGAPAAFKYFDTTIDRKRYTSTKEVLDATLIHQSITGLY
ETRIDLSQLGGD

FIG. 3A

Cas9/Csn1 Streptococcus pyogenes

Domains

1 MDKKYSIGLDIGTNSVGWAVITDDYKVPSKKLKGLGNTDRHGIKKNLIGAL
LFDSGETAEATRLKRTARRRYTRRKNRICYLQEIFSNEMAKVDDSFFHRLE
ESFLVEEDKKHERHPIFGNIVDEVAYHEKYPTIYHLRKKLADSTDKVDLRLI
YLALAHMIKFRGHFLIEGDLNPDNSDVDKLFIQLVQTYNQLFEENPINASRV
DAKAILSARLSKSRRLENLIAQLPGEKKNGLFGNLIALSLGLTPNFKSNFDLA
EDAKLQLSKDTYDDDLDNLLAQIGDQYADLFLAAKNLSDATLLSDILRVNSEI
TKAPLSASMIKRYDEHHQDLTLLKALVRQQLPEKYKEIFFDQSKNGYAGYID
GGASQEEFYKFIKPILEKMDGTEELLAKLNREDLLRKQRTFDNGSIPYQIHL
GELHAILRRQEDFYPFLKDNREKIEKILTFRIPYYVGPLARGNSRFAWMTRK
SEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKI
ECFDSVEISGVEDRFNASLGTYHDLLKIIKDKDFLDNEENEDILEDIVLTLTLF
EDREMIEERLKTYAHLFDDKVMKQLKRRRYTGWGRLSRKLINGIRDKQSG
KTILDFLKSDGFANRNFMQLIHDDSLTFKEDIQKAQVSGQGDSLHEHIANLA

2 GSPAIKKGILQTVKVVDELVKVMGRHKPENIVIEMARENQTTQKGQKNSR
ERMKRIEEGIKELGSDILKEYPVENTQLQNEKLYLYYLQNGRDMYVDQEL
DINRLSDYDVDHIVPQSFLKDDSIDNKVLTRSDKNRGKSDNVPSEEVVKK
MKNYWRQLLNAKLITQRKFDNLTKAERGGLSELDKVGFIKRQLVETRQIT
KHVAQILDSRMNTKYDENDKLIREVRVITLKSKLVSDFRKDFQFYKVREIN
NYHHAHDAYLNAVVGTALIKKYPKLESEFVYGDYKVYDVRKMIAKSEQEIG
KATAKYFFYSNIMNFFKTEITLANGEIRKRPLIETNGETGEIVWDKGRDFATV
RKVLSMPQVNIVKKTEVQTGGFSKESILPKRNSDKLIARKKDWDPKKYGGF
DSPTVAYSVLVVAKVEKGKSKKLKSVKELLGITIMERSSFEKDPIDFLEAKGY
KEVRKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVL
SAYNKHRDKPIREQAENIIHLFTLTNLGAPAAFKYFDTTIDRKRYTSTKEVLD
ATLIHQSITGLYETRIDLSQLGGD

FIG. 3B

Fig. 4A
Sequence identities relative to: S. pyogenes Cas9/Csn1

| species | reference sequence | Sequence identities - MUSCLE alignment | | |
|---|---|---|---|---|
| | | Full-length % identity | Domain 1 % identity | Domain 2 % identity |
| Streptococcus pyogenes M1 GAS | NP_269215 | 100.0 | 100.0 | 100.0 |
| Streptococcus pyogenes MGAS5005 | YP_282132.1 | 99.9 | 99.4 | 100.0 |
| Listeria innocua Clip11262 | NP_472073 | 54.3 | 60.0 | 64.9 |
| Pasteurella multocida subsp. multocida str. Pm70 | NP_246064.1 | 19.7 | 29.0 | 25.9 |
| Streptococcus thermophilus LMD-9 Csn1-A | YP_820832 | 59.2 | 75.6 | 72.4 |
| Streptococcus thermophilus LMD-9 Csn1-B | YP_820161.1 | 20.6 | 27.3 | 26.8 |
| Neisseria meningitidis Z2491 | YP_002342100.1 | 20.2 | 33.6 | 28.1 |
| Streptococcus mutans UA159 | NP_721764 | 64.9 | 78.1 | 74.1 |
| Streptococcus gordonii str. Challis substr. CH1 | YP_001450662.1 | 19.8 | 28.2 | 27.0 |
| Campylobacter jejuni subsp. jejuni NCTC 11168 | YP_002344900.1 | 19.6 | 30.3 | 26.3 |
| Treponema denticola ATCC 35405 | NP_970941 | 32.5 | 47.3 | 38.8 |

Fig. 4B
Sequence identities relative to: N. meningitidis Cas9/Csn1

| species | reference sequence | Sequence identities - MUSCLE alignment | | |
|---|---|---|---|---|
| | | Full-length % identity | Domain 1 % identity | Domain 2 % identity |
| Streptococcus pyogenes M1 GAS | NP_269215 | 20.2 | 33.6 | 28.1 |
| Streptococcus pyogenes MGAS5005 | YP_282132.1 | 20.3 | 34.5 | 28.1 |
| Listeria innocua Clip11262 | NP_472073 | 18.8 | 33.6 | 25.9 |
| Pasteurella multocida subsp. multocida str. Pm70 | NP_246064.1 | 64.3 | 72.1 | 69.0 |
| Streptococcus thermophilus LMD-9 Csn1-A | YP_820832 | 19.6 | 35.3 | 25.9 |
| Streptococcus thermophilus LMD-9 Csn1-B | YP_820161.1 | 25.8 | 35.7 | 35.1 |
| Neisseria meningitidis Z2491 | YP_002342100.1 | 100.0 | 100.0 | 100.0 |
| Streptococcus mutans UA159 | NP_721764 | 19.2 | 36.1 | 25.5 |
| Streptococcus gordonii str. Challis substr. CH1 | YP_001450662.1 | 25.3 | 37.5 | 35.8 |
| Campylobacter jejuni subsp. jejuni NCTC 11168 | YP_002344900.1 | 34.7 | 45.0 | 41.0 |
| Treponema denticola ATCC 35405 | NP_970941 | 18.8 | 31.5 | 25.5 |

|  | Motif 1 | Motif 2 | Motif 4 |
|---|---|---|---|
|  | * |  |  |
| S. pyogenes | ...IGLDIGTNSVGWAVI... | ...IVIEMARE... | ...HHAHDAYL... |
| L. pneumophila | ...IGIDLGGKFTGVCLS... | ...MMQRLAYE... | ...SHAIDATL... |
| G. proteobacterium | ...IAIDLGAKFTGVALY... | ...IIEHIARK... | ...SHVVDAVC... |
| L. innocua | ...IGLDIGTNSVGWAVL... | ...IVVEMARE... | ...HHAHDAYL... |
| L. gasseri | ...VGLDVGTNSCGWVAM... | ...IAIEFTRD... | ...HHAIDAYL... |
| E. rectale | ...LALDIGIASVGWAIL... | ...IVIEMPRD... | ...HHAVDAML... |
| S. lugdunensis | ...LGLDIGITSVGYGLI... | ...IIIELARE... | ...HHAEDALI... |
| M. synoviae | ...IGFDLGVASVGWSIV... | ...VVIEMARE... | ...HHAVDASI... |
| M. mobile | ...LGLDLGIASVGWCLT... | ...IVVEVTRS... | ...HHAEDAYF... |
| W. succinogenes | ...LGVDLGISSLGWAIV... | ...VHFELARE... | ...HHAVDAII... |
| F. columnare | ...LGLDLGTNSIGWAIR... | ...IHIEMARE... | ...HHTIDAIT... |
| F. succinogenes | ...LGLDLGTNSIGWAVV... | ...IHLELGRD... | ...HHAMDAIV... |
| B. fragilis | ...LGLDLGTNSIGWALV... | ...IRVELARE... | ...HHAMDALT... |
| A. cellulolyticus | ...LGVDVGERSIGLAAV... | ...IVVELARG... | ...HHAVDAVV... |
| B. dentium | ...IGIDVGLMSVGLAAI... | ...VQIEHVRE... | ...HHAVDAAV... |

|  | Motif 3 |
|---|---|
|  | * |
| S. pyogenes | ...DVDHIVPQSFLKD------DSIDNKVLTRSDKN... |
| L. pneumophila | ...EIDHIYPRSLSKKHFGVIFNSEVNLIYCSSQGN... |
| G. proteobacterium | ...EIDHIIPRSLTGRTKKTVFNSEANLIYCSSKGN... |
| L. innocua | ...DIDHIVPQSFITD------NSIDNLVLTSSAGN... |
| L. gasseri | ...DIDHILPQSFIKD------DSLENRVLVKKAVN... |
| E. rectale | ...EIDHIIPRSISFD------DARSNKVLVYRSEN... |
| S. lugdunensis | ...EVDHIIPRSVSFD------NSYHNKVLVKQSEN... |
| M. synoviae | ...EIDHVIPYSKSAD------DSWFNKLLVKKSTN... |
| M. mobile | ...DIDHIVPRSISFD------DSFSNLVIVNKLDN... |
| W. succinogenes | ...EIDHILPRSRSAD------DSFANKVLCLARAN... |
| F. columnare | ...DIEHTIPRSISQD------NSQMNKTLCSLKFN... |
| F. succinogenes | ...EIEHVIPQSLYFD------DSFSNKVICEAEVN... |
| B. fragilis | ...DIEHIIPQARLFD------DSFSNKTLEARSVN... |
| A. cellulolyticus | ...ELDHIVPRTDGG------SNRHENLAITCGACN... |
| B. dentium | ...EMDHIVPRKGVGS------TNTRVNLAAACAACN... |

```
                      1                                                      36
L. innocua      (1)   GUUUUAGAGCUAUGUUGUUAUUUGAAUGUAACAAAAC
S. pyogenes     (1)   GUUUUAGAGCUAUGCUGUUUUGAAUGGUCCCAAAAC
S. mutans       (1)   GUUUUAGAGCUGUGUUGUUUCGAAUGGUUCCAAAAC
S. thermophilus1 (1)  GUUUUAGAGCUGUGUUGUUUCGAAUGGUUCCAAAAC
```

Fig. 7B

```
                       1                                                                      37
C. jejuni        (1)   AUUUUACC--AUAAAGAAAUUAAAAAGGACUAAAAC
S. pyogenes      (1)   GUUUUAGA--CUAUGCUGUUUUGAAUGUCCAAAAC
F. novicida      (1)   GUUUCAGU--CUGAAUUGGUAAAACUACUGUUAG
M. mobile        (1)   GUUUUGGU--GUAGUAUCAUUUAUGUAUUCUAAAC
N. meningitidis  (1)   GUUGUAGC--UCCCUUUCUCAUUUCGCAGUGCUACAAU
P. multocida     (1)   GUUGUAGU--UCCCUCUCCAUUUCGCAGUGCUACAAU
S. thermophilus2 (1)   GUUUUUGU--ACUCUCAAGAUUUAAGUAAACUGUACAAC
```

| STRAIN | NUMBER OF CRISPRs | CASS4 CRISPR identifier[a] | CRISPR REPEAT:tracrRNA BASEPAIRING[b] |
|---|---|---|---|
| streptococcus pyogenes SF370 | 2 | NC_002737_1 | 5' GUUUUAG--AGCUAUGCUGUUUUGAAUGGUCCCAAAAC 3'<br>    \|\|\|\|•  \|\|\|\|\|\|\|\|\|\|\|\|\|\|\|\|\|\|\|\|\|\| \|\|\|\| \|<br>3' AAAUUGAACGAUACGACAAAACUUACCAAGGUUGUU 5' |
| Streptococcus mutans UA159 | 1 | NC_004350_1 | GUUUUAG--AGCUGUGUUGUUUCGAAUGGUUCCAAAAC<br>   \|\|\|\|•  \|\|\|\|\|\|\|\|\|\|\|\|\|\|\|\|\|\|\|\|\|\|\|•\| \|\|\|\| \|\|<br>AAAUUGAACGACACAACAAAGCUUACUAAGGUUGUG |
| Streptococcus thermophilus LMD-9 | 3 | NC_008532_5 | GUUUUAG--AGCUGUGUUGUUUCGAAUGGUUCCAAAAC<br>   \|\|\|\|•  \|\|\|\|\|\|\|\|\|\|\|\|\|\|\|\|\|\|\|\|\|\|\| \|\|\| \|\|<br>AAAUUGAGCGACACAACAAAGCUUACCAAAGUUUGG |
|  |  | NC_008532_2 | GUUUUUGUACUCU-CAAGAUUUAAGUAACUGUACAAC<br>   \|\|\|\|\|•  \|\|\|\|\|\|\|\|\|\|\|\|\|\|\|\|\|\|\|\|\|\|\|\| \|\|<br>AAACAUCGAAGACGUUCUAAAUUCAUUGACACAUUC |
| Listeria innocua Clip11262 | 1 | NC_003212_2 | GUUUUAG---AGCUAUGUUAUUUUGAAUGCUAACAAAC<br>   \|\|\|\|•   \|\|\|\|\|\|\|\|\|\|\|\|\|\|\|\|\|\|\|•\|\|\|\|\|\|\| \|<br>AAAUUGAACGAUACAAUAAAACUUAUGAUUGUAUA |
| Treponema denticola ATCC35405 | 1 | NC_002967_1 | GUUUUAG--AGUUGUGUAAUUUAAGAUGGAUCUCAAAC<br>   \|\|\|\|•  \|\|\|\|\|\|\|\|\|\|\|\|\|\|\|\|\|\|\|\|\|•\|\|\|\|\|\| \|\|<br>AACUGAGCAACACAUUAAAUUCUACCUAGAAUUUA |
| Neisseria meningitidis Z2491 | 2 | NC_003116_10 | GUUGUAGCUCCCUUUCUCAUUUCGCAGUGCUACAAU<br>•\|\|\|\|\|\|\|\|  \|   \|\|\|\|\|\|\|\|\|\|\|\|\|\|  \|\|\|\|<br>UAACAUCGUUGCCAAGAGUAAAGCGUCACGCUGUUA |
| streptococcus gordonii str. Challis substr. CH1 | 1 | NC_009785_2 | GUUUUUGUACUCU-CAAGAUUUAAGUAACUGUACAAC<br>   \|\|\|\|•  \|\|\|\|\|\|\|\|\|\|\|\|\|\|\|\|\|\|\|\|\|\|\|\| \|\|<br>AAACAUCGAAGACGUUCUAAAUUCAUUGACACAUUC |
| Bifidobacterium bifidum S17 | 1 | NC_014616_1 | GUUUCA-AUGCCUGUCAGAUCAAUGACUUUGACCAC<br>• \|\|\|\| \|\|\|\|\|\|\|\|\|\|\|\|\|\|\|\|\|\|\|\|\|•\|\| \|<br>AGUAAAUACGGACAGUCCAGUUACUGGAACUAGUA |
| Lactobacillus salivarius UCC118 | 1 | NC_007929_1 | GUUUCAGAAGUAUGUUAAAUCAUAAGGUUAAGACC<br>\|•   \|\| \|\| \|\|\|\|\|\|\|\|\|\| \|\| \|\|\|\|•\|\|•\|\|\|<br>AAGUUGAGUCUUACAAUUUAGUUACUCCAGUUUGG |
| Francisella tularensis subsp. novicida U112 | 2 | NC_008601_1[c] | CUAACAGUAGUUUACCAAAUAAUUCAGCAACUGAAAC<br>   \|\|\|•  •• \|\|\|\|\|\|\|\|\|\|\|\| \|•\|\|\|\|\|\|\|\|<br>UUGUGUUCAUGUAUGGUUUAUUAGAUUGUUGACUUUG<br><br>CUAACAGUAGUUUACCAAAUAAUUCA-GCAACUGAAAC<br>   \|   \|  \|•\| \|\|\|\|\|\|\|\|\|\|\| \| \| \|\|\| \|\|<br>UUUAAUAUUUACAUGGUUUAUUAAUUACG-AGACAUUA |
| Legionella pneumophila str. Paris | 1 | NC_006368_1 | CCAAUAAUCCCUCAUCUAAAAAUCCA-ACCACUGAAAC<br>   \|\|\|   \| \|\|\|\|\|\|\|\|\|\| \|\| \| \|\|\| \|\|\|\|\|\|<br>AUUUAAUCUUUAGUAGAUUUAAAGCUAUGG-GACUUUA |

FIG. 8

*Streptococcus pyogenes*
Base-pairing *in vivo* (crRNA /tracrRNA)
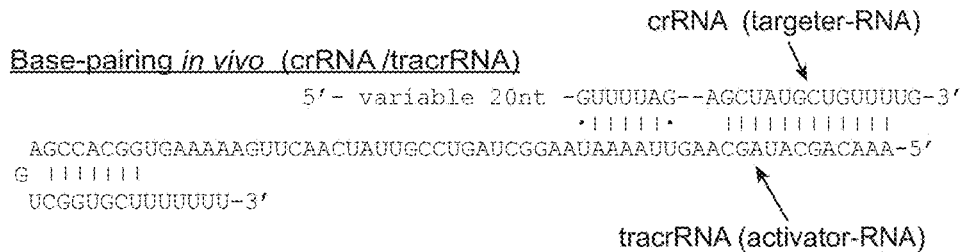
Example of a single-molecule DNA-targeting RNA
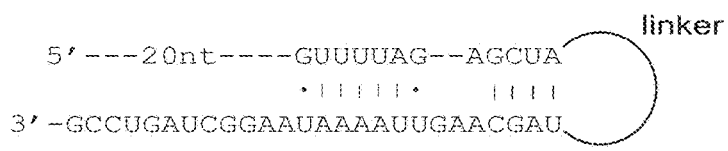
*Listeria innocua*
Base-pairing *in vivo* (crRNA/tracrRNA)
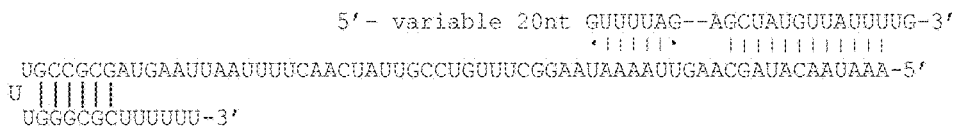
Example of a single-molecule DNA-targeting RNA
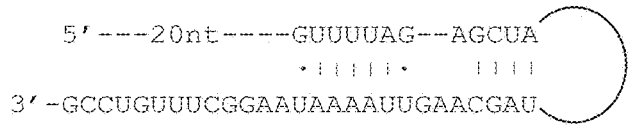
FIG. 9

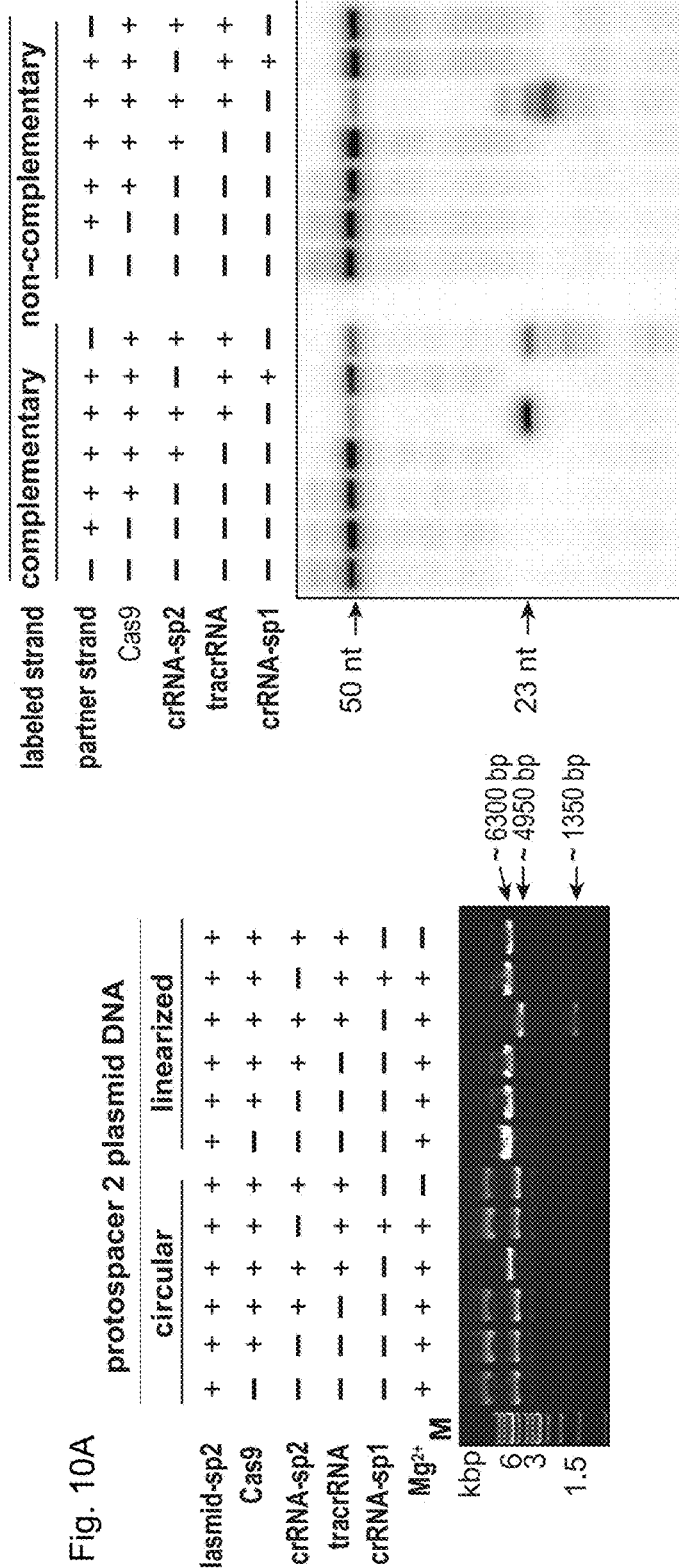

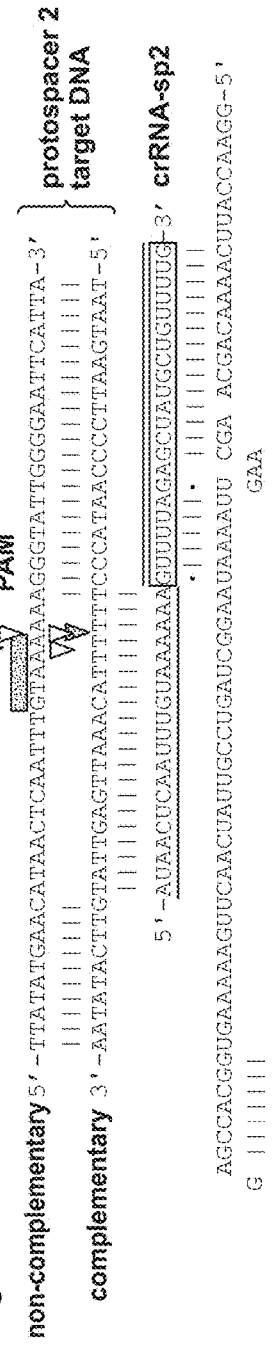
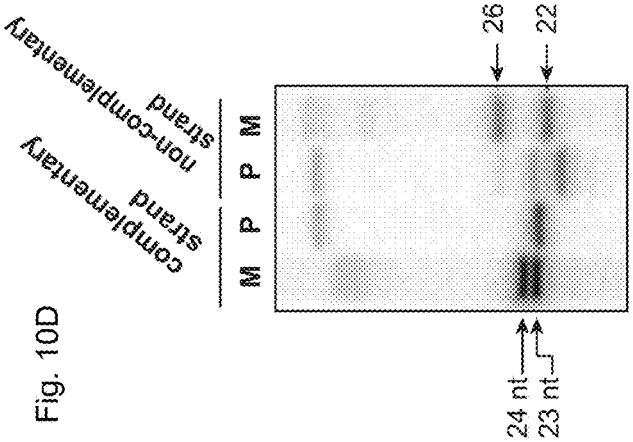
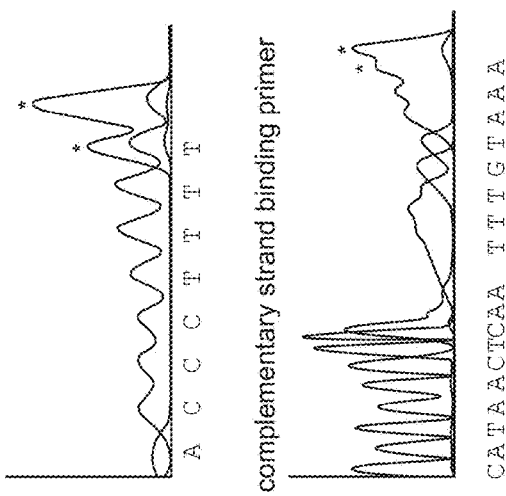

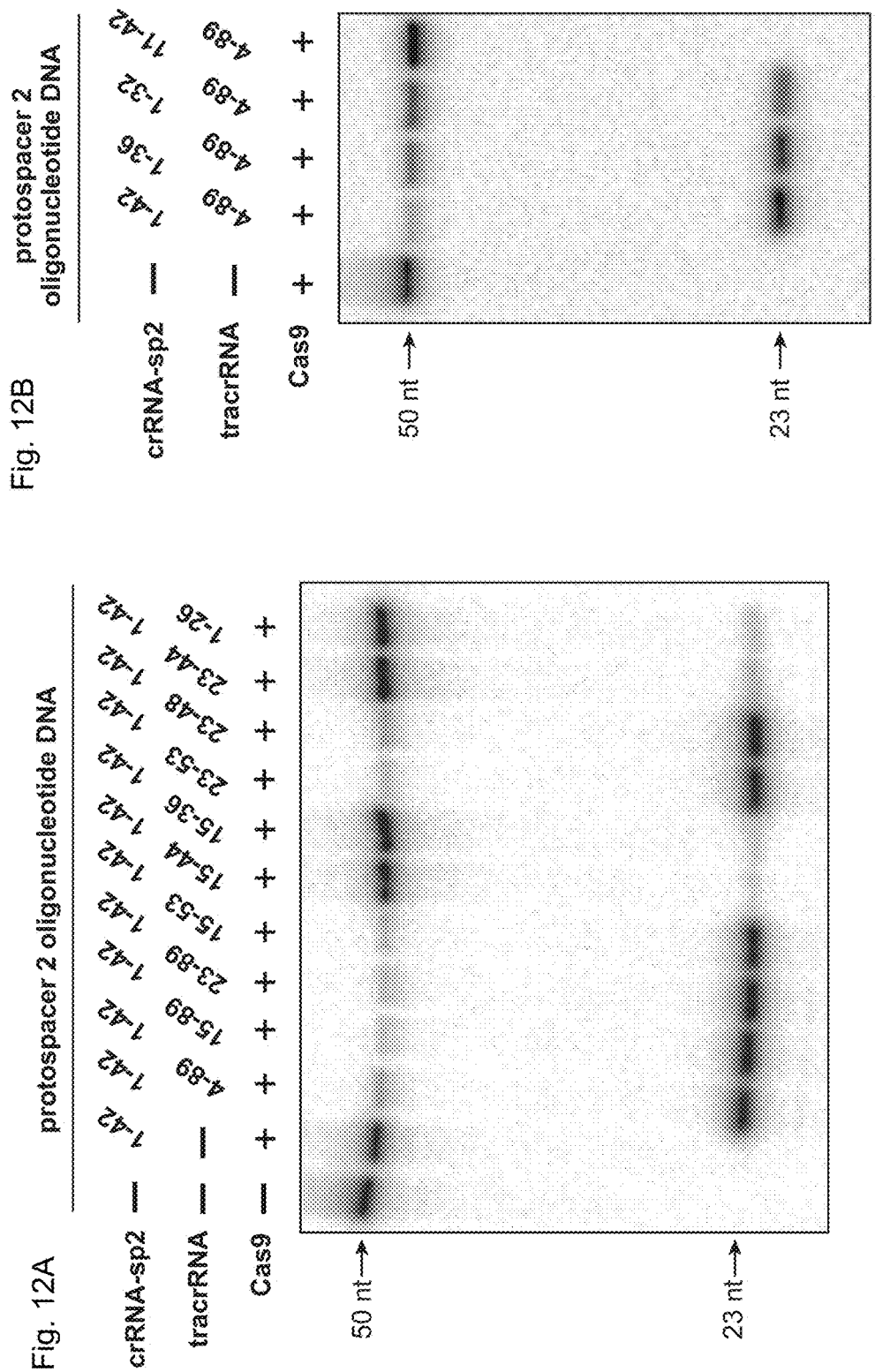

Fig. 14A
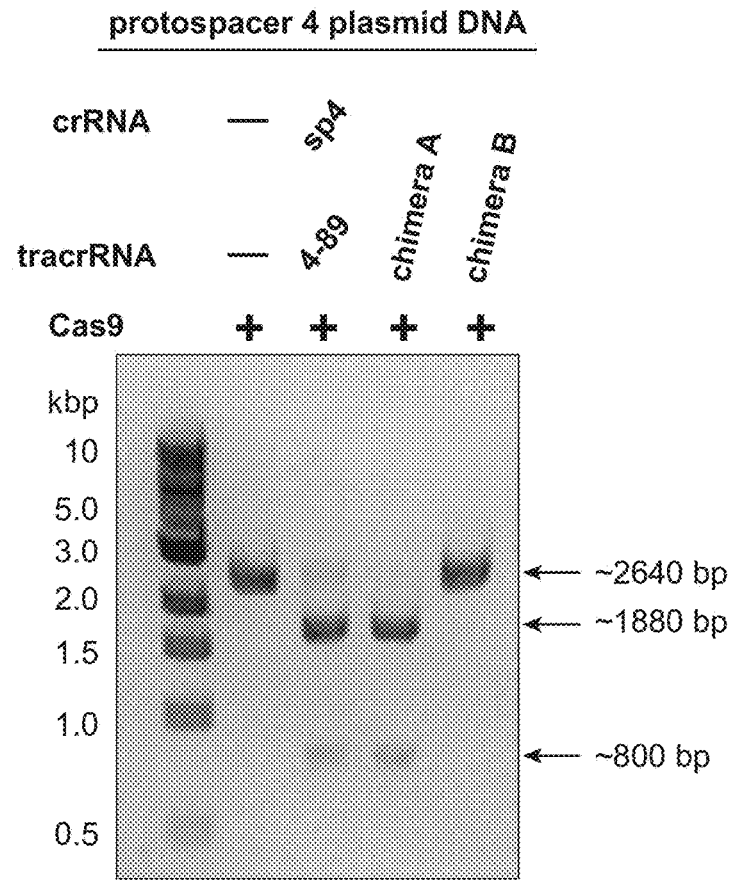
chimera A
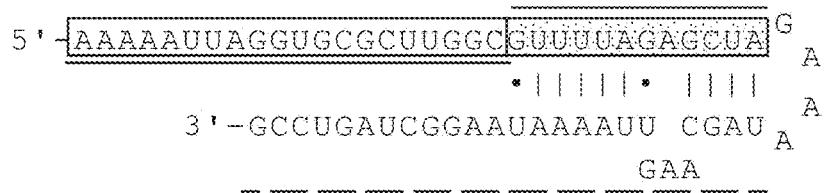
chimera B
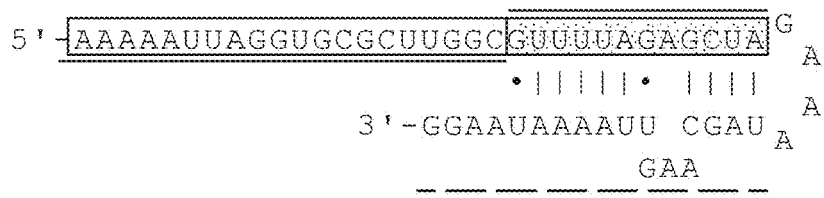

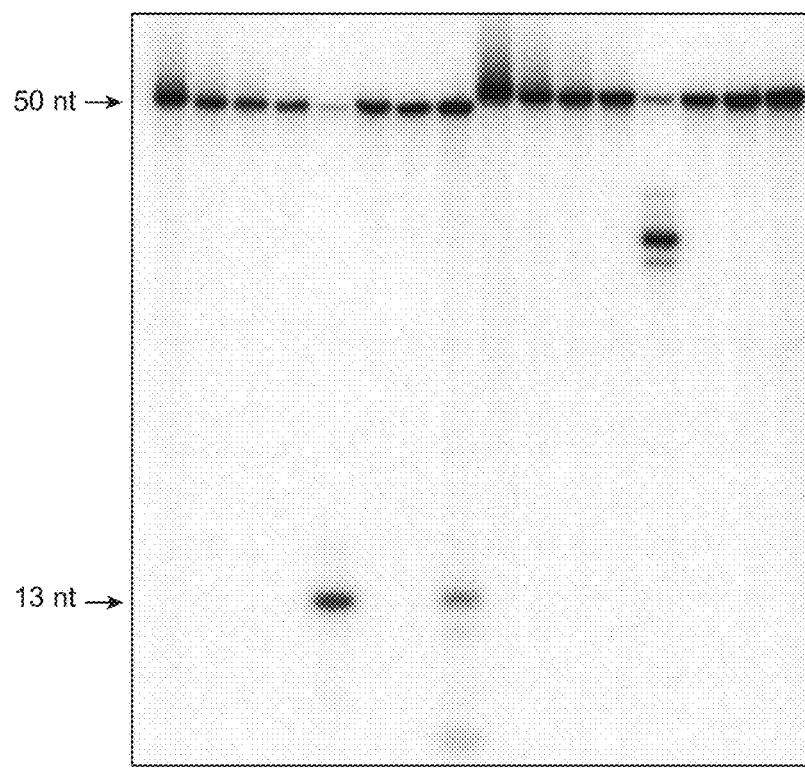

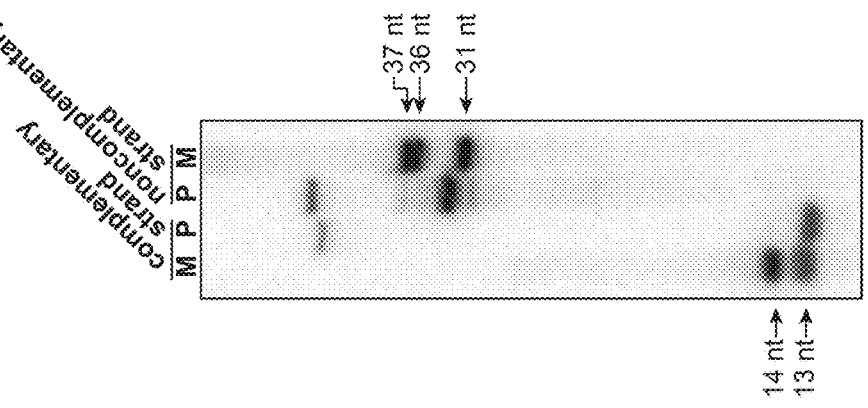
Fig. 19B protospacer 4 oligonucleotide DNA
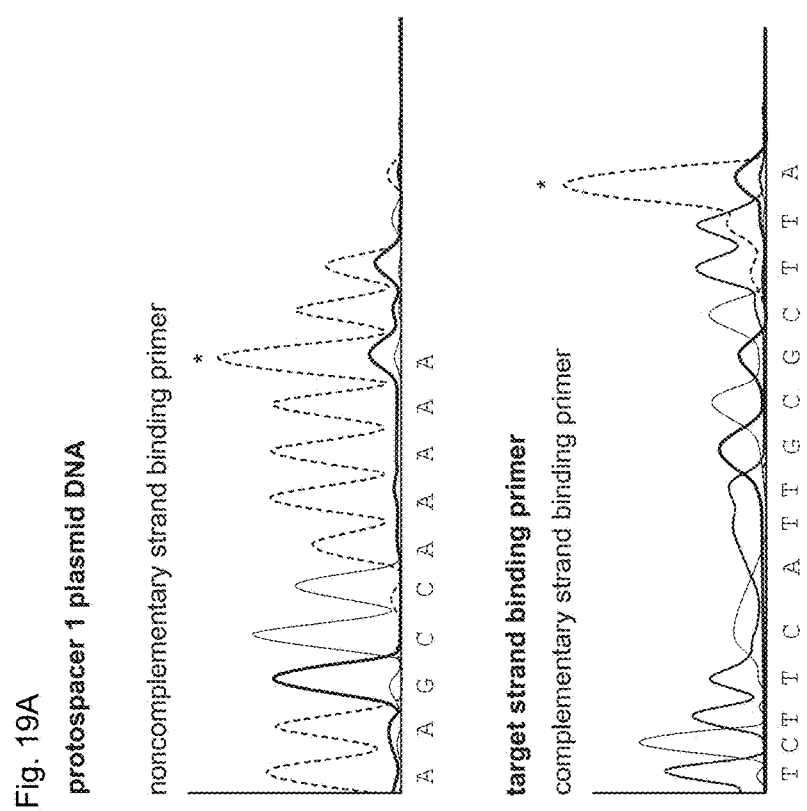
Fig. 19A protospacer 1 plasmid DNA

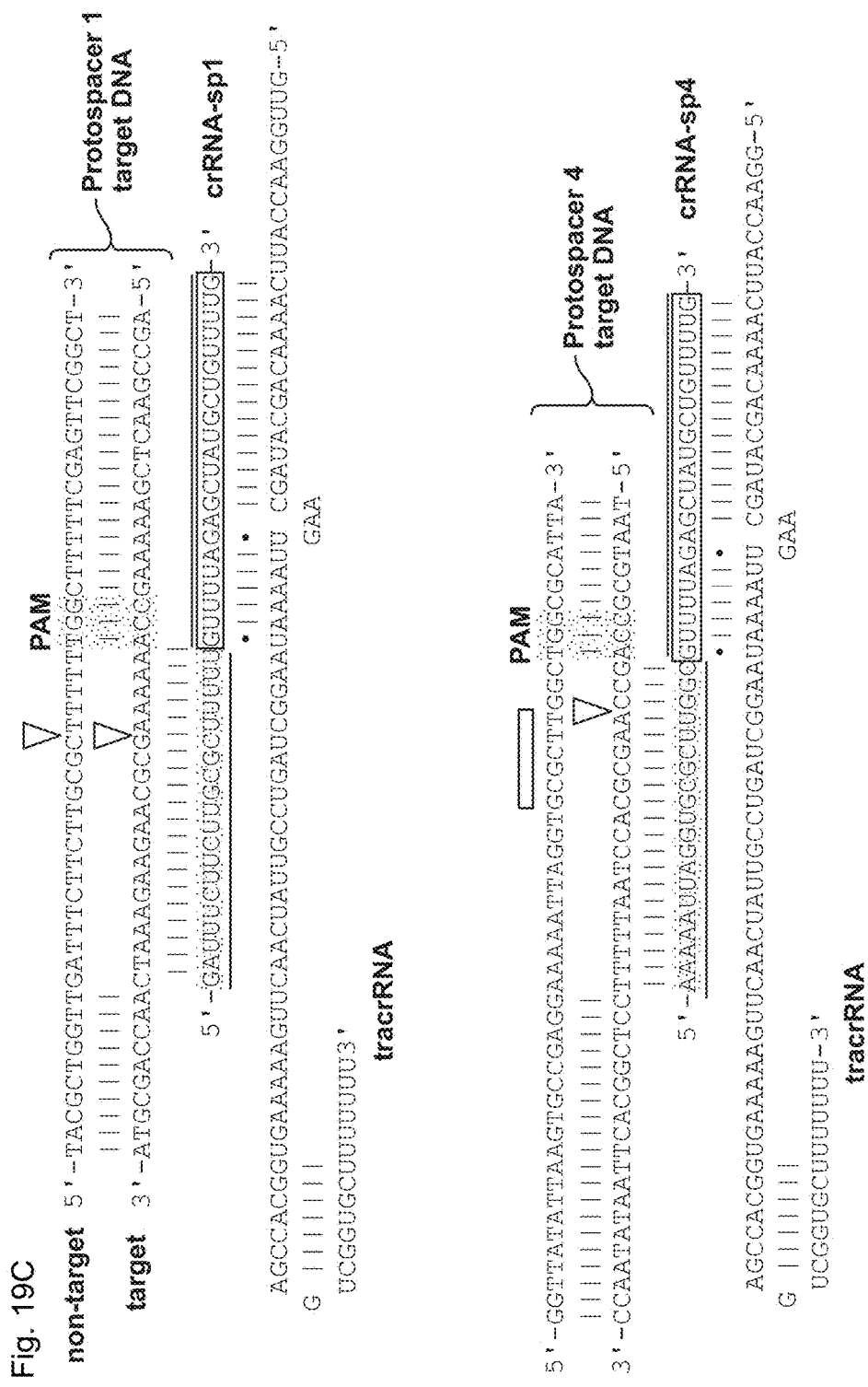

Fig. 20A
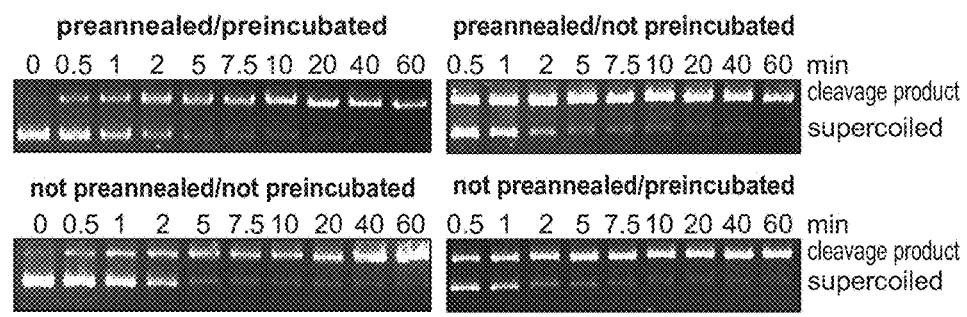
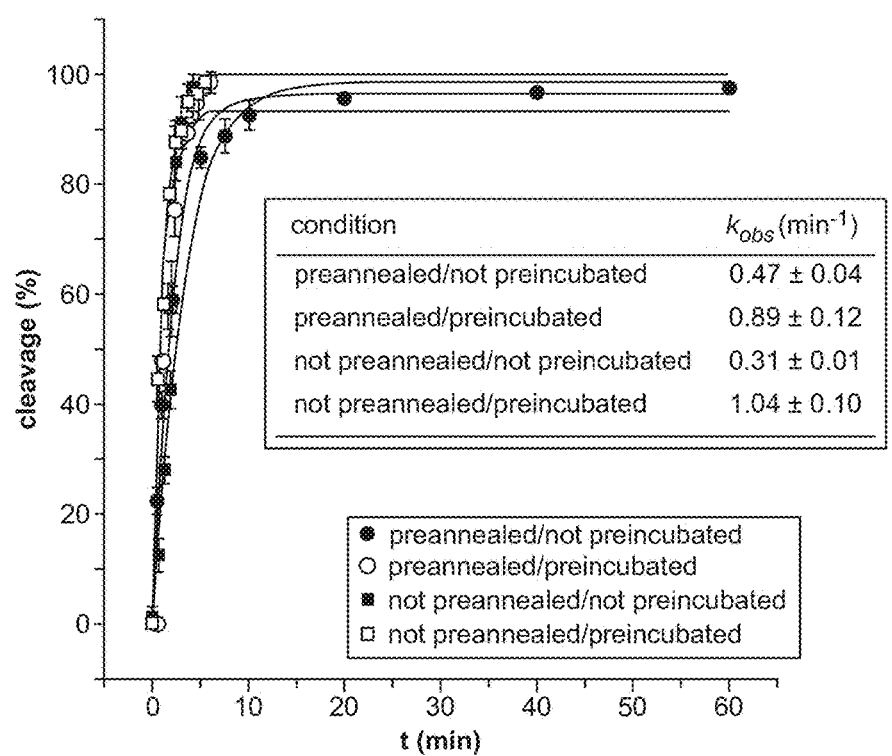

Fig. 20B
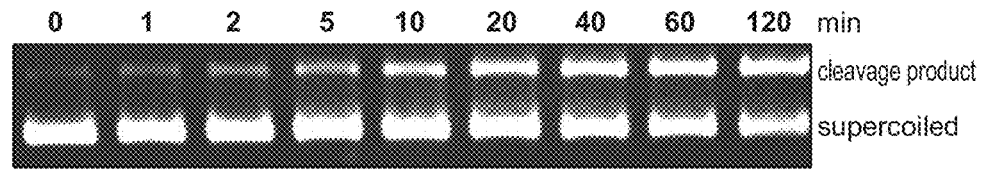
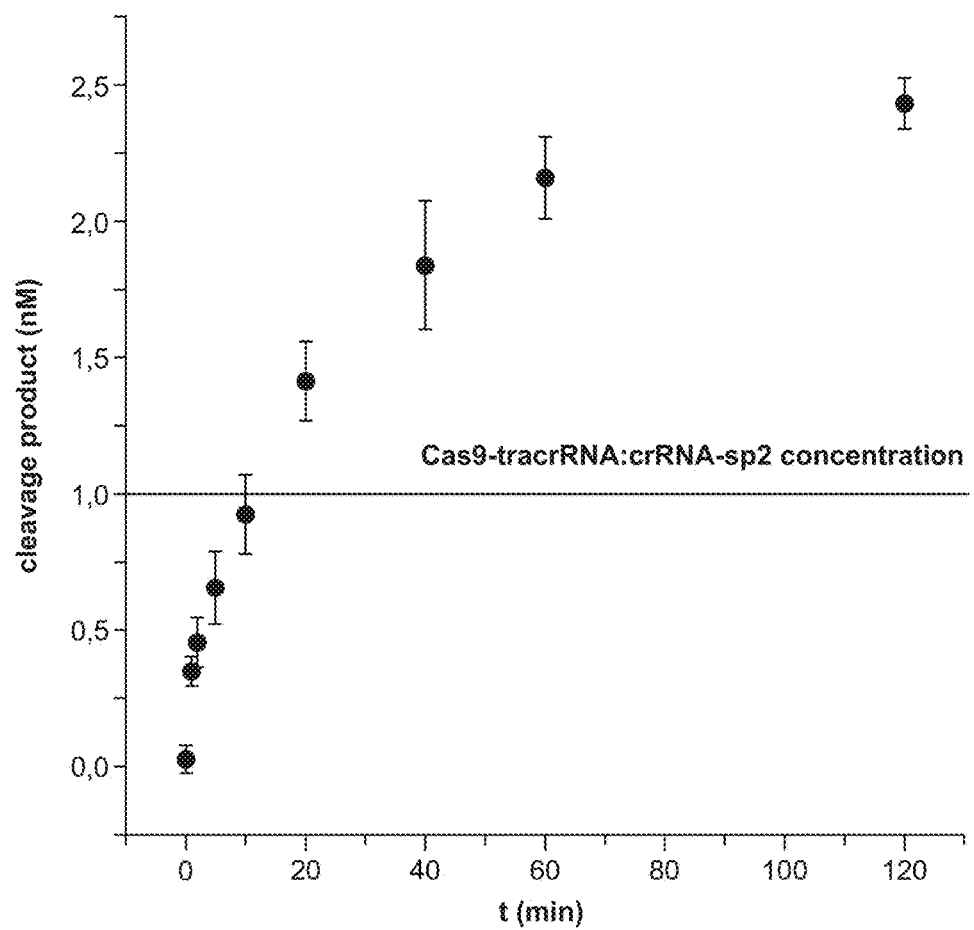

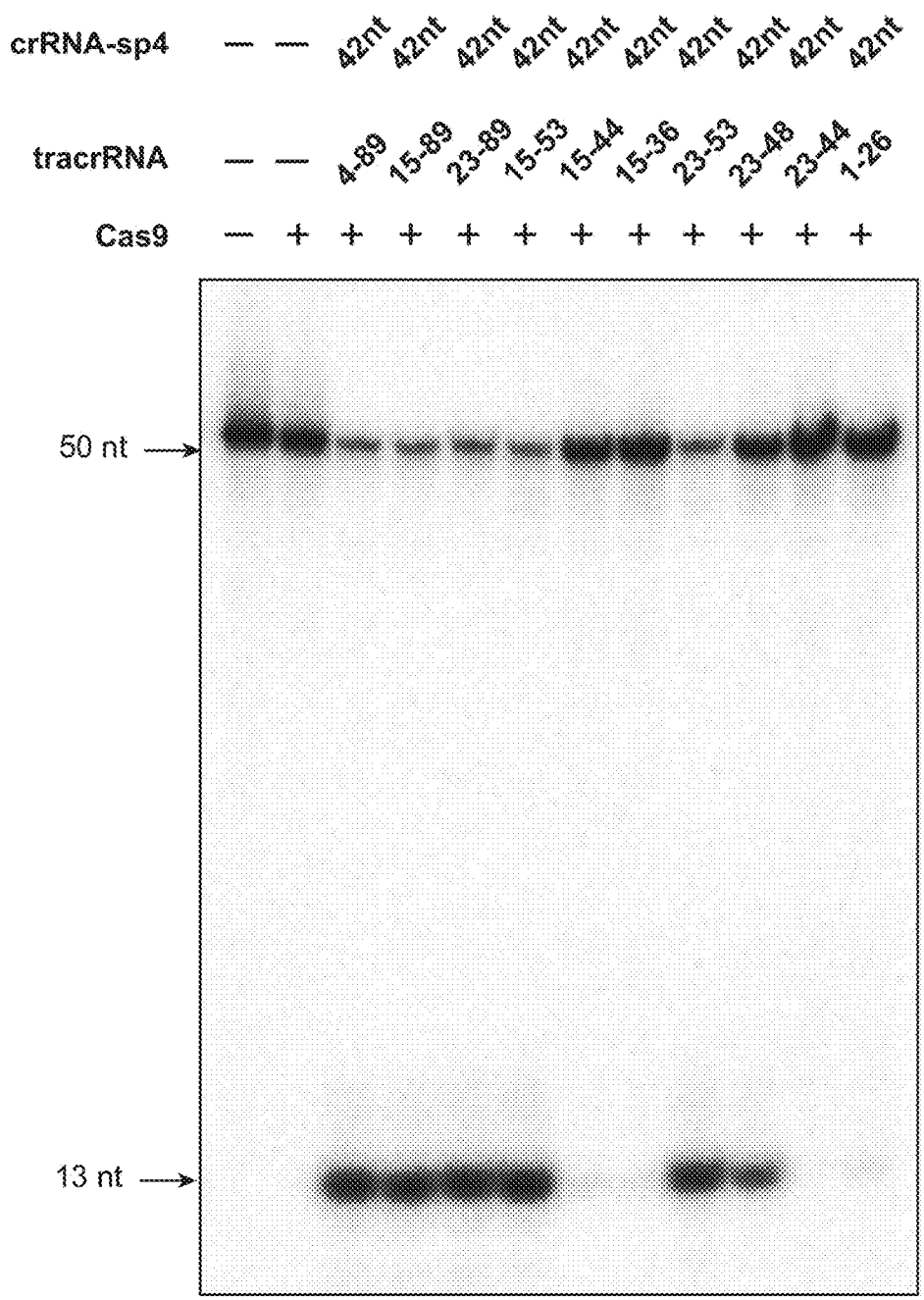

| | S. pyogenes | L. innocua | S. thermophilus | C. jejuni | N. meningitidis |
|---|---|---|---|---|---|
| S. pyogenes | x | 54 | 58 | 16 | 16 |
| L. innocua | 54 | x | 52 | 15 | 14 |
| S. thermophilus | 58 | 52 | x | 16 | 15 |
| C. jejuni | 16 | 15 | 16 | x | 32 |
| N. meningitidis | 16 | 14 | 15 | 32 | x |

Fig. 24C

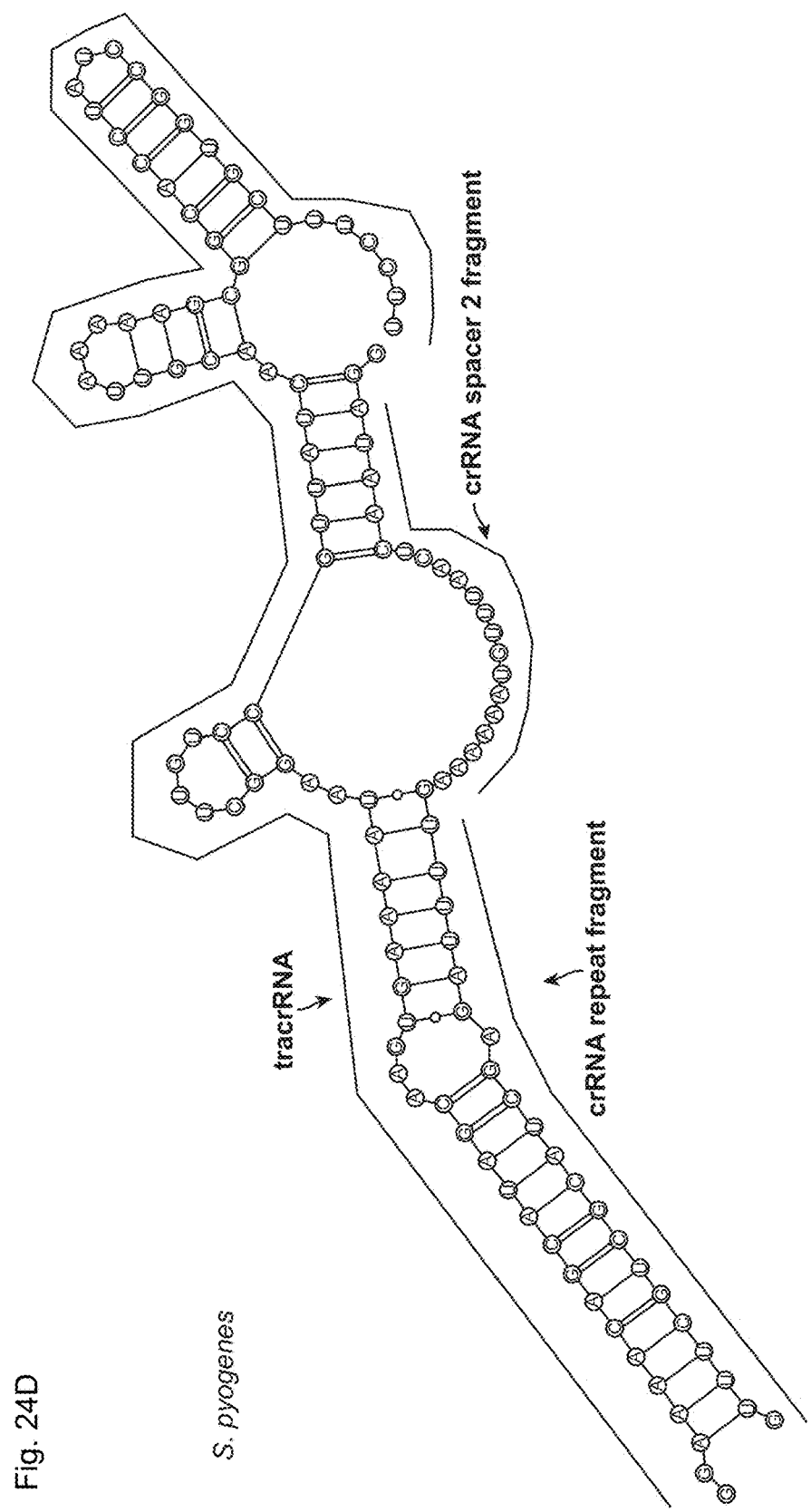

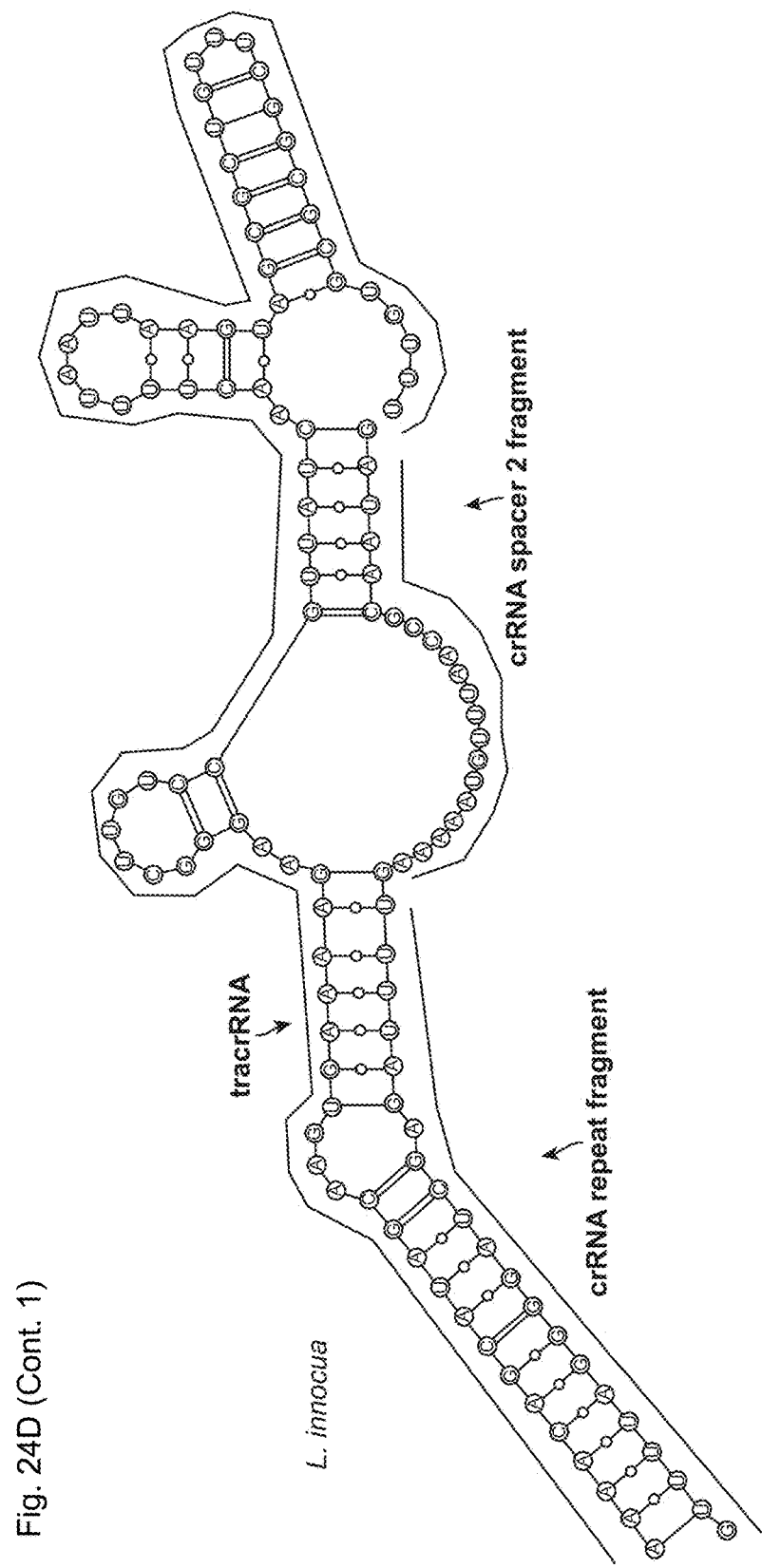
Fig. 24D (Cont. 1)

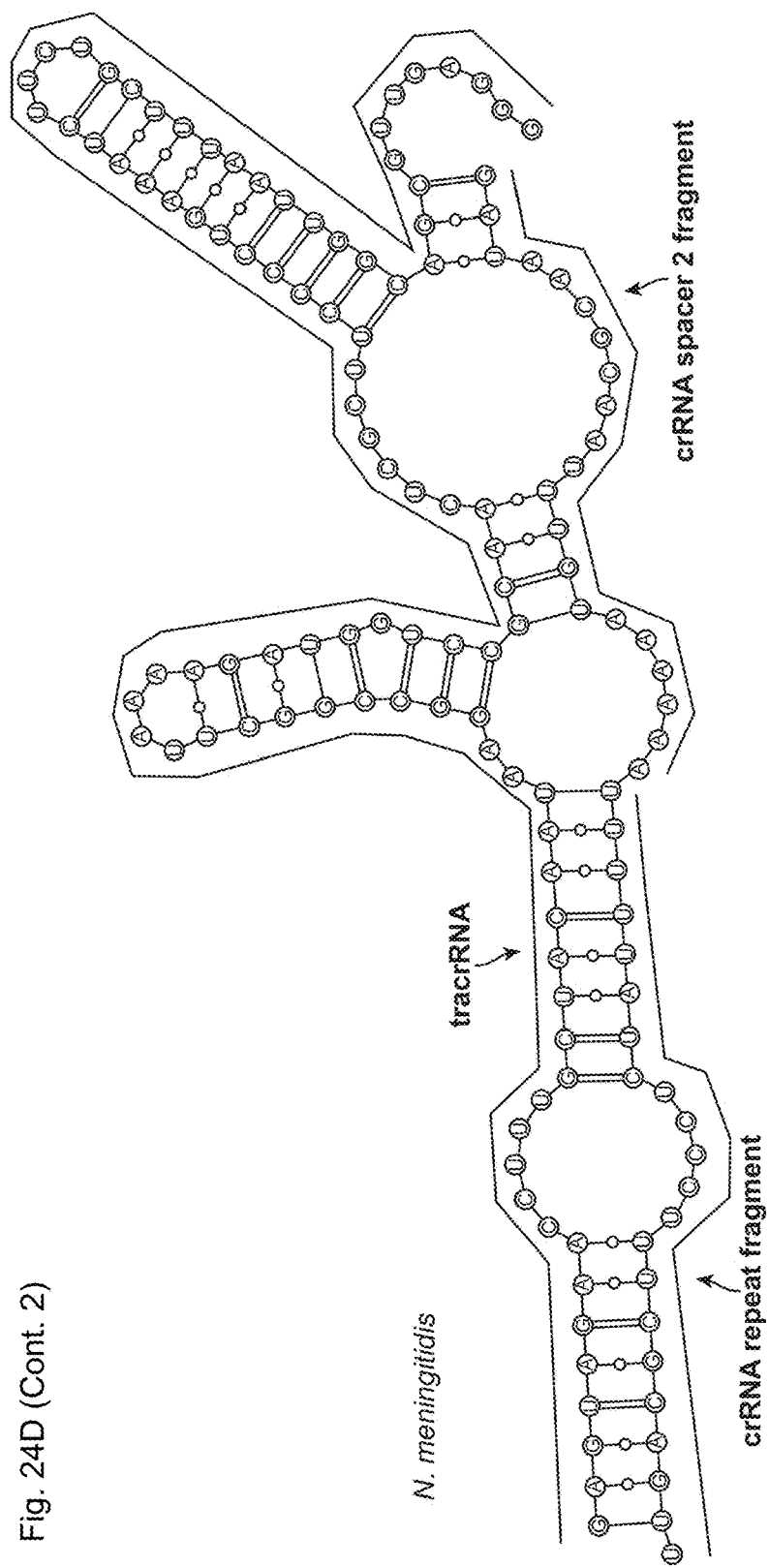
Fig. 24D (Cont. 2)

Fig. 25A

Target DNA probe 5  3'-TTTTTAAT-5'

4  3'-TAATCCAC-5'

3  3'-CCACGCGA-5'

2  3'-GCGAACCG-5'

1  3'-ACCGACCGCGTAAT-5'

5'-AAAAAUUAGGUGGCGUUGGCGUUUUAGAGCUAUGCUGUUUUG-3' spacer 4 crRNA (1-42)

tracrRNA (15-89)

AGCCACGGUGAAAAGUUCAACUAUUGCCUGAUCGGAAUAAAAAUU CGAUACGACAA-5'
G ||||||                                     GAA
UCGGUGCUUUUUU-3'

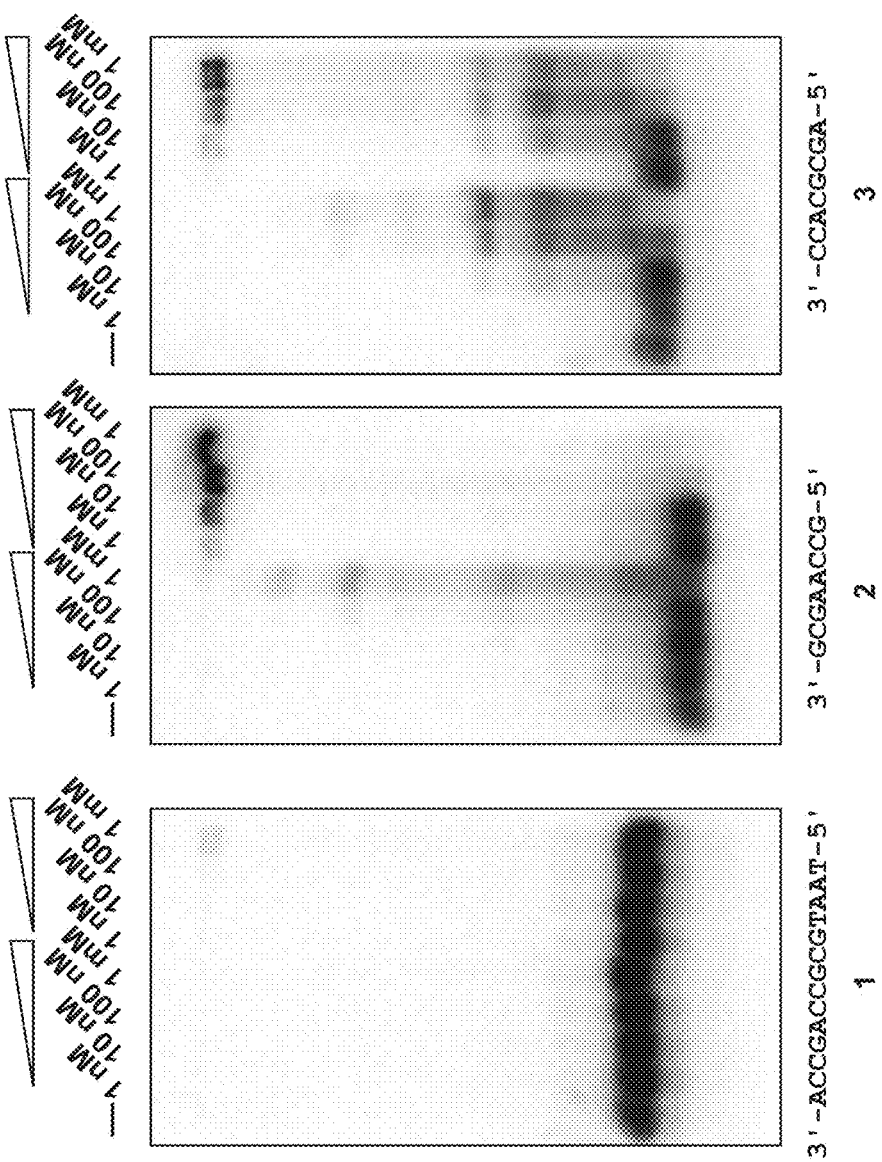

protospacer 2 target

|  | | PAM |
| --- | --- | --- |
| WT | 5'-ATAACTCAATTTGTAAAAAA- | GGGTA-3' |
| PAM G→C | 5'-ATAACTCAATTTGTAAAAAA- | GCGTA-3' |
| PAM GG→CC | 5'-ATAACTCAATTTGTAAAAAA- | GCCTA-3' | protospacer 4 target

WT    5'-AAAAATTAGGTGCGCTTGGC-TGGCG-3'

PAM1  5'-AAAAATTAGGTGCGCTTGGC-TCGCG-3'

PAM2  5'-AAAAATTAGGTGCGCTTGGC-TGCCG-3'

PAM3  5'-AAAAATTAGGTGCGCTTGGC-TGGCC-3'

PAM4  5'-AAAAATTAGGTGCGCTTGGC-TCCCC-3'

DPAM  5'-AAAAATTAGGTGCGCTTGGC-T-3'

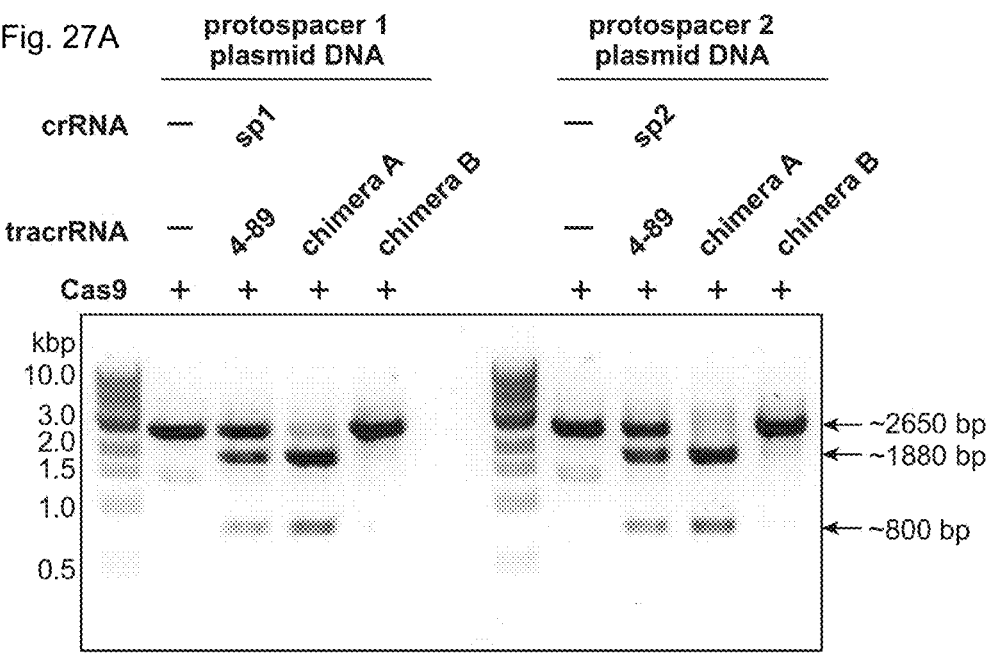
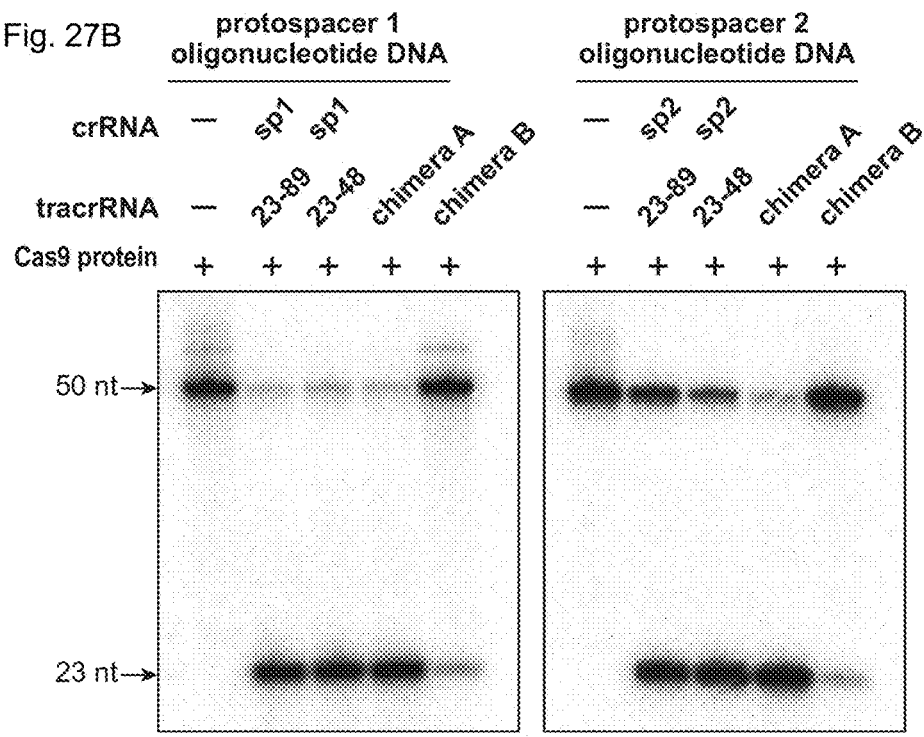

Fig. 27C
protospacer 1 targeting chimeric RNAs
chimera A
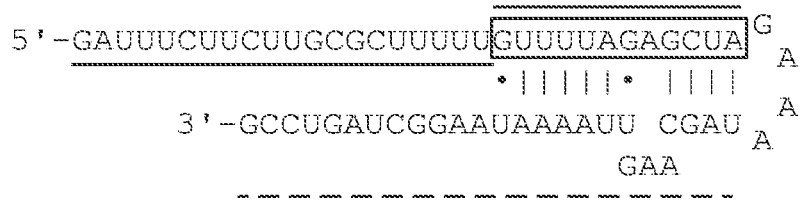
chimera B
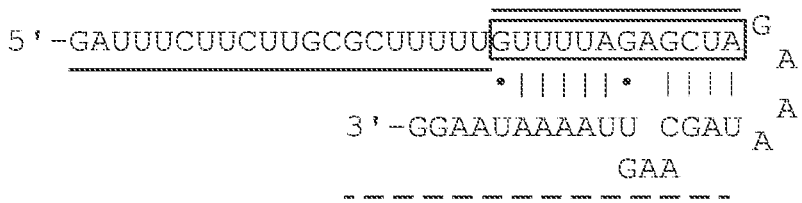
protospacer 2 targeting chimeric RNAs
chimera A
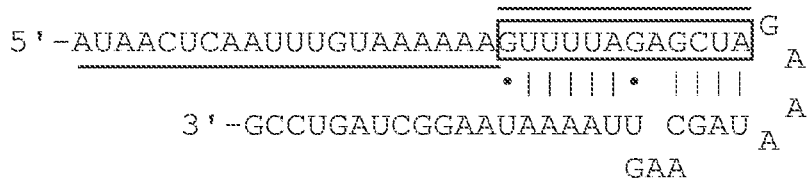
chimera B
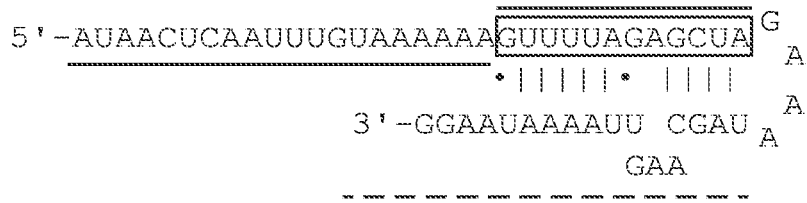

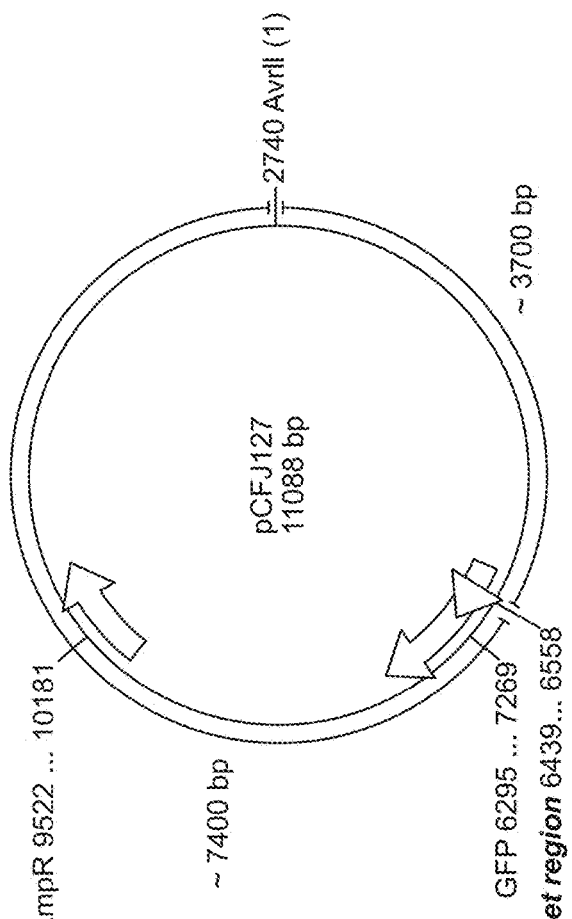

Fig. 28C  Target sequence                              PAM

GFP1   CCAATTCTTGTTGAATTAGA-TGGTGA

5'--CCAAUUCUUGUUGAAUUAGAGAGUUUUAGAGCUAG    A
         •|||||•|||||      |||||•|||||        A
   3'--GCCUGAUCGGAAUAAAAAUU  CGAUA
                                    GAA

GFP2   AATTAGATGGTGATGTTAAT-GGGCAC

5'--AAUUAGAUGGUGAUGUUAAUGUUUUAGAGCUAG    A
         •|||||•|||||      |||||•|||||        A
   3'--GCCUGAUCGGAAUAAAAAUU  CGAUA
                                    GAA

GFP3   AAATTTTCTGTCAGTGGAGA-GGGTGA

5'--AAAUUUUCUGUCAGUGGAGAGUUUUAGAGCUAG    A
         •|||||•|||||      |||||•|||||        A
   3'--GCCUGAUCGGAAUAAAAAUU  CGAUA
                                    GAA

GFP4   CATCTAATTCAACAAGAATT-GGGACA

5'--CAUCUAAUUCAACAAGAAUUGUUUUAGAGCUAG    A
         •|||||•|||||      |||||•|||||        A
   3'--GCCUGAUCGGAAUAAAAAUU  CGAUA
                                    GAA

GFP5   CAGTAGTGCAAATAAATTTA-AGGGTA

5'--CAGUAGUGCAAAUAAAUUUAGUUUUAGAGCUAG    A
         •|||||•|||||      |||||•|||||        A
   3'--GCCUGAUCGGAAUAAAAAUU  CGAUA
                                    GAA

Fig. 29C
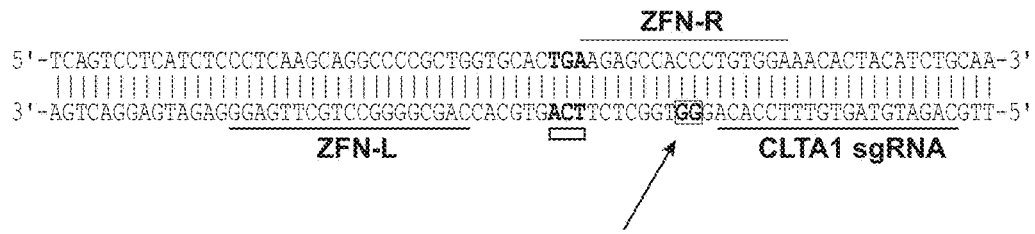
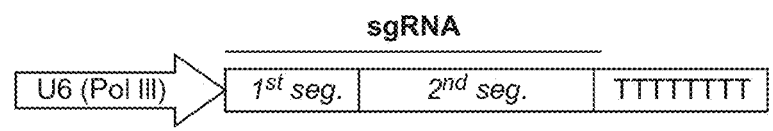
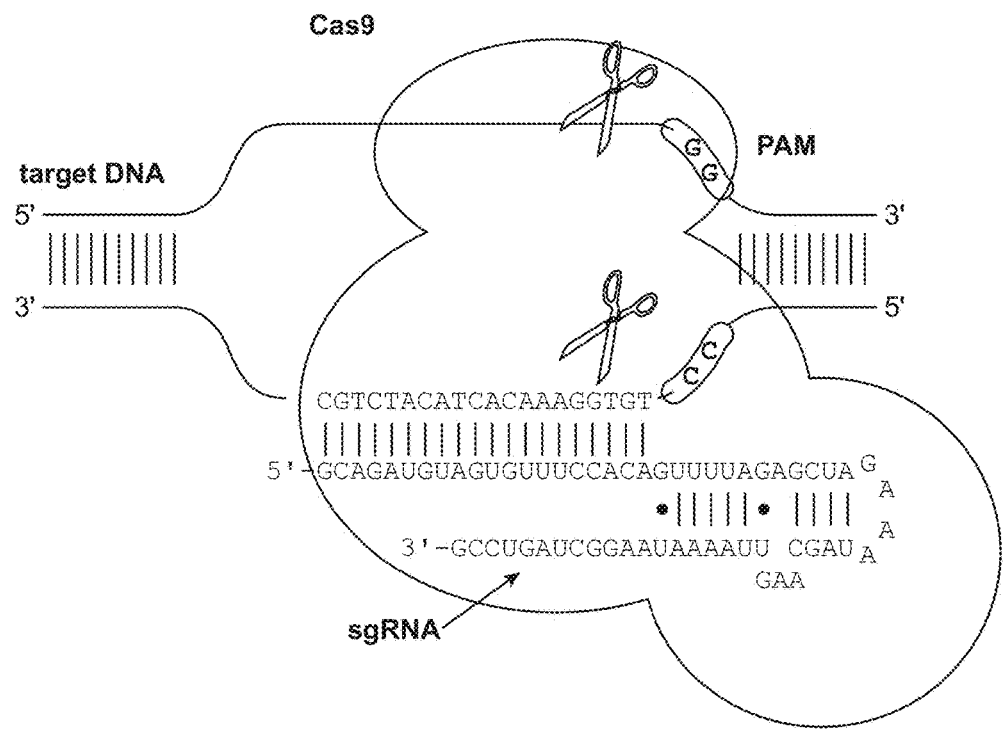

Type II-A

Francisella novicida U112

Wolinella succinogenes DSM 1740 gamma proteobacterium HTCC5015

Sutterella wadsworthensis 3 1 45B

Parasutterella excrementihominis YIT11859

Legionella pneumophila str. Paris

Type II-B (Continued)

Staphylococcus pseudintermedius ED99

Eubacterium rectale ATCC 33656

Enterococcus faecalis TX0012

Streptococcus thermophilus LMD-9

Staphylococcus lugdunensis M23590

Eubacterium dolichum DSM 3991

Mycoplasma mobile 163K

Mycoplasma ovipneumoniae SC01

Mycoplasma gallisepticum str. F

Mycoplasma canis PG 14

Mycoplasma synoviae 53

Fig. 34A
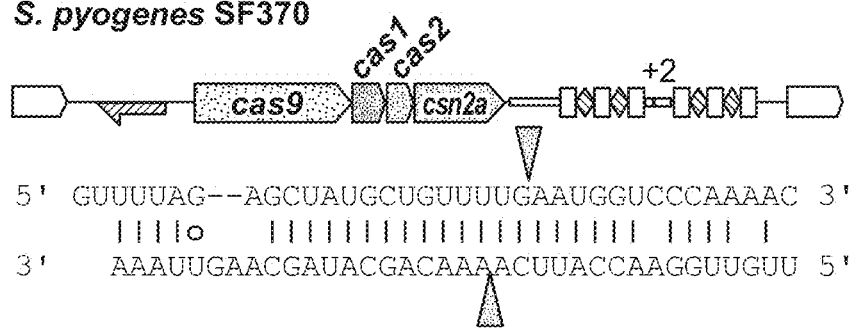
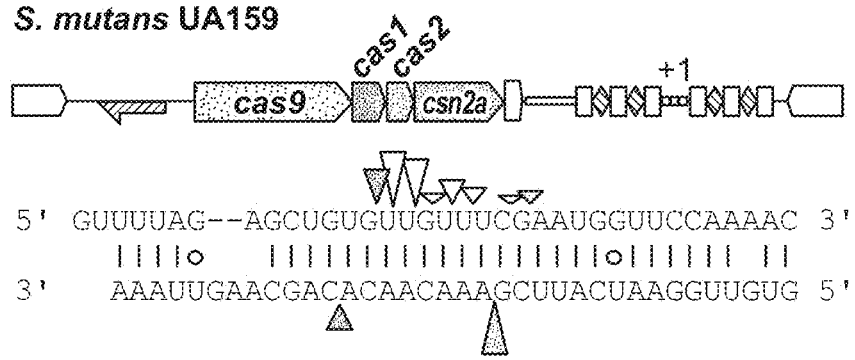
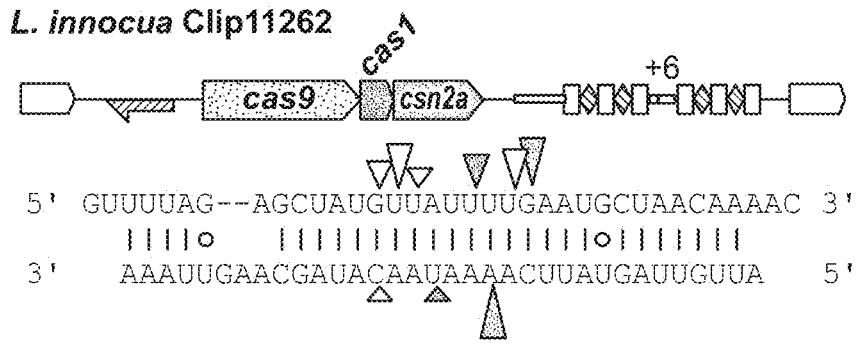
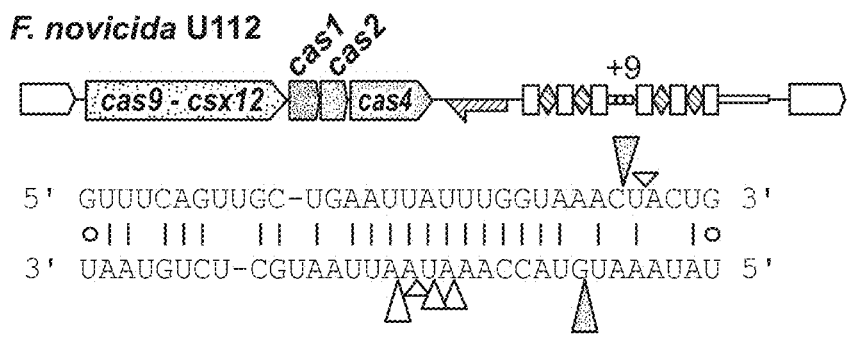

| sRNA | Strand | Size mature form | Region of interest | Reads | Coverage [%] | Sequence | 5' end read number | | 3' end read number | |
|---|---|---|---|---|---|---|---|---|---|---|
| crRNA 4 spacers | → | | | | | *C. jejuni* NCTC 11168 (NC_002163.1), total mapped reads: 9914184 | | | | |
| | | crRNA1 | 36 1455167 1455202 | 781 | 0,0079 | AGTTTTAAAAGAGCTTGGCGGTTGTTTAGT CCCTTTTT | 1455162 A<br>1455165 G<br>1455166 C<br>1455167 A<br>1455168 G<br>1455169 T<br>1455170 T<br>1455171 T<br>1455172 T<br>1455173 T<br>1455174 A | 1<br>2<br>3<br>419<br>19<br>7<br>75<br>24<br>9<br>11<br>4 | 1455198 T<br>1455199 C<br>1455200 C<br>1455201 C<br>1455202 T<br>1455203 T<br>1455204 T<br>1455205 T<br>1455206 T | 5<br>5<br>16<br>72<br>385<br>82<br>30<br>112<br>5 |
| | | crRNA2 | 38 1455231 1455268<br>29 1455240 1455268 | 2658 | 0,0268 | CAAAGTTTCATTAGTTGAATTAACTGTTTTA GTCCCTTTTT | 1455227 T<br>1455228 T<br>1455230 C<br>1455231 C<br>1455232 A<br>1455233 A<br>1455234 A<br>1455235 G<br>1455236 T<br>1455237 T<br>1455238 C<br>1455239 C<br>1455240 A<br>1455241 T<br>1455242 T<br>1455243 A<br>1455244 G | 4<br>1<br>37<br>206<br>72<br>34<br>59<br>280<br>168<br>130<br>36<br>259<br>317<br>148<br>298<br>157<br>40 | 1455264 T<br>1455265 C<br>1455266 C<br>1455267 C<br>1455268 T<br>1455269 T<br>1455270 T<br>1455271 T<br>1455272 T<br>1455273 A | 3<br>14<br>60<br>240<br>1364<br>348<br>29<br>44<br>15<br>2 |

Fig. 37B

| sRNA | Strand | Size mature form | Region of interest | Reads | Coverage (%) | Sequence | 5' end read number | | 3' end read number | |
|---|---|---|---|---|---|---|---|---|---|---|
| crRNA 4 spacers | | | | | | *C. jejuni* NCTC 11168 (NC_002163.1), total mapped reads: 9914184 | | | | |
| | crRNA3 | 35 | 1455300 1455334 | 4729 | 0,0477 | AAGAATGAGGATGATGATATTTACAGTTTTA GTCCTTTTT | 1455292 | T | 1455329 | G | 16 | 21 |
| | | | | | | | 1455293 | C | 1455330 | T | 62 | 479 |
| | | | | | | | 1455294 | T | 1455331 | C | 5 | 23 |
| | | | | | | | 1455295 | A | 1455332 | C | 12 | 48 |
| | | | | | | | 1455296 | C | 1455333 | C | 23 | 179 |
| | | | | | | | 1455297 | A | 1455334 | T | 367 | 1226 |
| | | | | | | | 1455298 | A | 1455335 | T | 143 | 220 |
| | | | | | | | 1455299 | G | 1455336 | T | 563 | 54 |
| | | | | | | | 1455300 | A | 1455337 | T | 1014 | 49 |
| | | | | | | | 1455301 | A | 1455338 | T | 415 | 55 |
| | | | | | | | 1455302 | T | 1455339 | A | 242 | 1 |
| | | | | | | | 1455303 | G | | | 589 | |
| | | | | | | | 1455304 | A | | | 55 | |
| | | | | | | | 1455305 | G | | | 2 | |
| | crRNA4 | 26 | 1455376 1455401 | 17404 | 0,1755 | GTGTGCTAAAAAAATGGACTTAAATGTTTTA GTCCTTTTT | 1455360 | T | 1455398 | C | 6 | 63 |
| | | | | | | | 1455361 | G | 1455399 | C | 2 | 645 |
| | | | | | | | 1455362 | A | 1455400 | T | 9 | 9844 |
| | | | | | | | 1455363 | G | 1455401 | T | 261 | 1518 |
| | | | | | | | 1455364 | T | 1455402 | T | 51 | 481 |
| | | | | | | | 1455365 | G | 1455403 | T | 598 | 763 |
| | | | | | | | 1455366 | T | 1455404 | T | 77 | 578 |
| | | | | | | | 1455367 | G | 1455405 | A | 552 | 4 |
| | | | | | | | 1455368 | C | | | 579 | |
| | | | | | | | 1455369 | T | | | 901 | |
| | | | | | | | 1455370 | A | | | 816 | |
| | | | | | | | 1455371 | A | | | 227 | |
| | | | | | | | 1455372 | A | | | 262 | |
| | | | | | | | 1455373 | A | | | 1072 | |
| | | | | | | | 1455374 | A | | | 1269 | |
| | | | | | | | 1455375 | A | | | 1991 | |
| | | | | | | | 1455376 | A | | | 2204 | |
| | | | | | | | 1455377 | T | | | 1978 | |
| | | | | | | | 1455378 | | | | 371 | |

Fig. 37C

| sRNA | Strand | Size mature form | Region of interest | Reads | Coverage (%) | Sequence | 5' end read number | 3' end read number |
|---|---|---|---|---|---|---|---|---|
| tracrRNA | → | | | | | *C. jejuni* NCTC 11168 (NC_002163.1), total mapped reads: 9914184 | | |
| | | tracrRNA1 | 65 1455502 1455566 | 833829 | 8,4105 | AAGAAATTAAAAAGGACTAAAATAAGAGT TGCGGGACTCTGCGGGGTTACAATCCCCTAA ACCGCTTTT | 1455496 T 1 | 1455565 G 12371 |
| | | tracrRNA2 | 58 1455509 1455566 | | | | 1455497 A 31 | 1455566 C 713292 |
| | | | | | | | 1455498 A 27 | 1455567 T 74594 |
| | | | | | | | 1455499 G 24 | 1455568 T 10412 |
| | | | | | | | 1455500 A 19 | 1455569 T 9580 |
| | | | | | | | 1455501 A 232 | 1455570 A 426 |
| | | | | | | | 1455502 A 435 | 1455571 A 91 |
| | | | | | | | 1455503 T 369 | 1455572 A 97 |
| | | | | | | | 1455504 T 253 | 1455573 A 542 |
| | | | | | | | 1455505 T 85 | |
| | | | | | | | 1455506 A 65 | |
| | | | | | | | 1455507 A 193 | |
| | | | | | | | 1455508 A 33472 | |
| | | | | | | | 1455509 A 615001 | |
| | | | | | | | 1455510 A 131879 | |
| | | | | | | | 1455511 G 16444 | |
| | | | | | | | 1455512 G 9390 | |
| | | | | | | | 1455513 G 1053 | |

Fig. 37D

| sRNA | Strand | Size mature form | Region of interest | Reads | Coverage (%) | Sequence | 5' end read number | 3' end read number |
|---|---|---|---|---|---|---|---|---|
| crRNA 13 spacers | → | | | | | *F. novicida U112 (NC_008601.1), total mapped reads: 48205* | | |
| | | crRNA5 52 | 817556 | 117 | 0,2427 | ATAACTCGACCAATATTTGACAAAGTTCAGT TGCTGAATTATTTGGTAAACCT | 817612 T 10<br>817611 A 10<br>817607 A 53<br>817606 T 7 | 817557 A 3<br>817556 C 55<br>817555 T 13<br>817553 C 12<br>817552 T 1 |
| | | crRNA6 56 | 817627 | 116 | 0,2406 | GGCAGGTTTGTATGGTCATATAGGAGTGTTT CAGTTGCTGAATTATTTGGTAAACCT | 817685 A 4<br>817682 G 23<br>817681 G 13<br>817679 A 2<br>817677 G 4 | 817629 A 4<br>817628 A 3<br>817627 C 53<br>817626 T 20 |
| | | crRNA7 66 | 817699 | 11 | 0,0228 | AGCTATAGGGTTACCTATCTTTTGAGTGTGG CAAATAAGTTTCAGTTGCTGAATTATTTGGTA AACCT | 817764 A 4<br>817763 G 1<br>817754 T 4<br>817745 T 2 | 817699 A 2 |
| | | crRNA9 53 | 817845 | 24 | 0,0498 | ATGCTTTTAAACTACTGATATATACGTTCAG TTGCTGAATTATTTGGTAAACT | 817897 A 3 | 817845 C 7 |
| tracrRNA | ← | tracrRNA1 74 | 817065 | 2808 | 5,8251 | GTACCAATAATTAATGCTCTGTAATCATTTA AAGTATTTGAACGACCTCTGTTTGACACG TCTGAATAACTAAAAA | 817140 A 2<br>817139 T 2<br>817138 G 615<br>817136 A 9<br>817135 C 2<br>817134 C 37<br>817133 A 26<br>817132 A 7<br>817131 A 328<br>817130 T 355<br>817129 A 165<br>817128 A 484<br>817127 T 24<br>817126 A 55<br>817125 A 32<br>817124 A 19 | 817066 A 28<br>817065 C 1523<br>817064 T 440<br>817063 A 7<br>817062 A 10<br>817061 A 19<br>817060 A 14<br>817059 A 6<br>817058 G 5<br>817057 C 32<br>817055 A 10 |
| | | tracrRNA2 64 | 817065 | | | | | |

Fig. 37E

| sRNA | Strand | Size mature form | Region of interest | Reads | Coverage (%) | Sequence | 5' end read number | | | 3' end read number | | |
|---|---|---|---|---|---|---|---|---|---|---|---|---|
| crRNA 16 spacers | → | | | | | *N. meningitidis* AZ2491 (NC_003116.1), total mapped reads: 13110087 | | | | | | |
| | | crRNA1 | | | | TATCCATTCCAGCCGGAAATTAAGTTGTAGC TCCCCTTCTCATTCGCAGT | 608453 | T | 30 | 608500 | T | 25 |
| | | | 48 | 608456 | 1346 | 0,0103 | | 608454 | G | 105 | 608501 | C | 77 |
| | | | | | | | 608455 | T | 64 | 608502 | G | 175 |
| | | | | | | | 608456 | A | 259 | 608503 | C | 293 |
| | | | | | | | 608457 | T | 4 | 608504 | A | 78 |
| | | | | | | | 608458 | C | 21 | 608505 | G | 505 |
| | | | | | | | 608459 | C | 175 | 608507 | T | 1 |
| | | | | | | | 608460 | A | 118 | | | |
| | | | | | | | 608461 | T | 39 | | | |
| | | crRNA2 | 50 | 608520 | 685 | 0,0052 | GCCTTTTTACAAGCTCGCTTCTTTGTTGTAG CTCCCTTCTCATTCGCAGT | 608517 | T | 5 | 608564 | T | 8 |
| | | | | | | | 608518 | C | 41 | 608565 | T | 16 |
| | | | | | | | 608519 | T | 7 | 608566 | T | 8 |
| | | | | | | | 608520 | G | 61 | 608567 | C | 31 |
| | | | | | | | 608521 | C | 21 | 608568 | G | 101 |
| | | | | | | | 608522 | C | 44 | 608569 | C | 173 |
| | | | | | | | 608523 | T | 21 | 608570 | A | 43 |
| | | | | | | | 608524 | T | 31 | 608571 | G | 6 |
| | | | | | | | 608525 | T | 17 | 608572 | T | 2 |

Fig. 37F

| sRNA | Strand | Size mature form | Region of interest | Reads | Coverage (%) | Sequence | 5' end read number | | 3' end read number | |
|---|---|---|---|---|---|---|---|---|---|---|
| | | | | | | N. meningitidis AZ2491 (NC_003116.1), total mapped reads: 13110087 | | | | |
| crRNA3 | | 50 | 608586 | 12402 | 0,0946 | TAAAGTTTCTGTTGCGACCCGAATGTTGTAG CTCCCTTTCTCATTCGCAGT | 608583 | T | 608631 | T | 75 |
| | | | | | | | 608584 | G | 608632 | T | 114 |
| | | | | | | | 608585 | G | 608633 | C | 414 |
| | | | | | | | 608586 | T | 608634 | G | 1510 |
| | | | | | | | 608587 | A | 608635 | C | 2219 |
| | | | | | | | 608588 | A | 608636 | A | 297 |
| | | | | | | | 608589 | A | 608637 | G | 52 |
| | | | | | | | 608590 | G | 608638 | T | 8 |
| | | | | | | | 608591 | G | | | 1152 |
| crRNA4 | | 49 | 608653 | 26361 | 0,2011 | TAACTTTGACCGTGTGCAATCCAGTTAGTTGT AGCTCCCTTTCTCATTTCGCAGT | 608646 | T | 608697 | T | 295 |
| | | | | | | | 608647 | C | 608698 | T | 569 |
| | | | | | | | 608648 | T | 608699 | C | 1167 |
| | | | | | | | 608649 | T | 608700 | G | 4910 |
| | | | | | | | 608650 | T | 608701 | C | 4968 |
| | | | | | | | 608651 | A | 608702 | A | 764 |
| | | | | | | | 608652 | A | 608703 | G | 62 |
| | | | | | | | 608653 | C | 608704 | T | 4 |
| | | | | | | | 608654 | T | | | 3665 |
| | | | | | | | 608655 | T | | | 382 |

Fig. 37G

| sRNA | Strand | Size mature form | Region of interest | Reads | Coverage (%) | Sequence | 5' end read number | | 3' end read number | |
|---|---|---|---|---|---|---|---|---|---|---|
| | | | | | | *N. meningitidis* AZ2491 (NC_003116.1), total mapped reads: 13110087 | | | | |
| crRNA5 | | 49 | 608719 | 28747 | 0,2193 | AACCCACTAAATTTGCAAATGCGGTTGTAGC TCCCTTTCTCATTTCGCAGT | 608717<br>608718<br>608719<br>608720<br>608721<br>608722<br>608723<br>608724 | G 20<br>C 1171<br>A 8128<br>A 116<br>C 59<br>C 420<br>C 1089<br>A 557 | 608764<br>608765<br>608766<br>608767<br>608768<br>608769<br>608770 | T 426<br>C 1316<br>G 3040<br>C 6431<br>A 1049<br>G 102<br>T 11 |
| crRNA6 | | 50 | 608784 | 121014 | 0,9231 | TTTTTTTGTACTGTTGTTTGAACGAGTGTAG CTCCCTTTCTCATTTCGCAGT | 608781<br>608782<br>608783<br>608784<br>608785<br>608786<br>608787 | G 42<br>C 630<br>C 10039<br>T 26026<br>T 11430<br>T 8248<br>T 3648 | 608830<br>608831<br>608832<br>608833<br>608834<br>608835<br>608836 | T 2295<br>C 7060<br>G 13864<br>C 44472<br>A 6853<br>G 802<br>T 69 |
| crRNA7 | | 52 | 608848 | 24611 | 0,1877 | TTCGTTTCAGATAGCAAAGCAGTAGTGTTGT AGTTCCTTTCTCATTTCGCAGT | 608846<br>608847<br>608848<br>608849<br>608850<br>608851<br>608852<br>608853 | A 28<br>A 631<br>T 11039<br>C 753<br>C 239<br>G 2205<br>T 1910<br>T 826 | 608896<br>608897<br>608898<br>608899<br>608900<br>608901<br>608902 | T 369<br>C 1114<br>G 3441<br>C 9015<br>A 1558<br>G 137<br>T 8 |
| | | 84 | 608916 | 901 | 0,0069 | ATATGACGGTTGGCAACTGGTACAGGTTGTAG CTCCCTTTCTCATTTCCAGTGCTACAATGCC GGATATGACGGTGGGCAACT | 608913<br>608914<br>608915<br>608916<br>608917<br>608918<br>608919 | C 6<br>G 3<br>G 2<br>A 266<br>T 17<br>A 96<br>T 26 | 608996<br>608997<br>608998<br>608999<br>609000<br>609001<br>609004 | A 6<br>A 2<br>C 2<br>T 259<br>G 171<br>G 24<br>T 16 |

Fig. 37H

| sRNA | Strand | Size mature form | Region of interest | Reads | Coverage (%) | Sequence | 5' end read number | 3' end read number |
|---|---|---|---|---|---|---|---|---|
| | | | | | | *N. meningitidis AZ2491 (NC_003116.1), total mapped reads: 13110087* | | |
| crRNA10 | | 49 | 609049 609097 | 5027 | 0,0383 | CTTTGTATTGATTCAAGGTGCTTGTTGTAGC TCCCTTTCTCATTTCGCAGT | 609046 T 89 609047 C 37 609048 G 647 609049 C 1614 609050 T 583 609051 T 208 609052 T 104 609053 T 18 | 609094 T 81 609095 C 218 609096 G 845 609097 C 1237 609098 A 219 609099 G 36 609101 G 7 |
| crRNA11 | | 52 | 609112 609163 | 22711 | 0,1732 | ATTCGTCGATGATGGAAACTCGAGCATGTTGT AGCTCCCTTTCTCATTTCGCAGT | 609109 A 58 609110 G 331 609111 T 99 609112 A 10627 609113 T 1234 609114 T 66 609115 C 191 609116 T 4906 609117 T 136 | 609160 T 540 609161 C 1263 609162 C 2850 609163 C 4882 609164 A 552 609165 G 52 609166 T 15 |
| crRNA12 | | 52 | 609178 609229 | 5067 | 0,0386 | TAGCCAGTGCTAAAACCGCACCCGCTTGTTGT AGCTCCCTTTCTCATTTCGCAGT | 609175 G 4 609176 G 3 609177 G 42 609178 T 897 609179 A 72 609180 G 584 609181 C 154 609182 C 314 609183 A 38 | 609226 T 57 609227 C 189 609228 G 576 609229 C 1348 609230 A 321 609231 G 33 609232 T 2 |

Fig. 371

| sRNA | Strand | Size mature form | Region of interest | Reads | Coverage (%) | Sequence | 5' end read number | | 3' end read number | | |
|---|---|---|---|---|---|---|---|---|---|---|---|
| *N. meningitidis* A22491 (NC_003116.1), total mapped reads: 13110087 | | | | | | | | | | | |
| crRNA13 | | 51 | 609245 609295 | 4666 | 0,0356 | ATAGAAATACATACGCCGAGTAATTAGTTGTA GCTCCCTTTCTCATTTCGCAGT | 609243<br>609244<br>609245<br>609246<br>609247<br>609248 | A<br>A<br>A<br>T<br>A<br>G | 6<br>62<br>1311<br>141<br>116<br>44 | 609292<br>609293<br>609294<br>609295<br>609296<br>609297<br>609298 | T<br>C<br>G<br>C<br>A<br>G<br>T | 65<br>201<br>475<br>1039<br>229<br>25<br>1 |
| crRNA14 | | 51 | 609311 609361 | 7147 | 0,0545 | TTTTTGTAATTGTTCTGCCTTTTTAGTTGTA GCTCCCTTTCTCATTTCGCAGT | 609308<br>609309<br>609310<br>609311<br>609312<br>609313<br>609314<br>609315 | T<br>T<br>C<br>T<br>T<br>T<br>T<br>T | 12<br>22<br>207<br>1190<br>774<br>577<br>195<br>37 | 609358<br>609359<br>609360<br>609361<br>609362<br>609363<br>609364 | T<br>C<br>G<br>C<br>A<br>G<br>T | 136<br>442<br>858<br>2335<br>540<br>69<br>5 |
| crRNA15 | | 50 | 609378 609427 | 49818 | 0,3800 | ACGGCGAAACCATTGCCACAAAACGTTGTAG CTCCCTTTCTCATTTCGCAGT | 609375<br>609376<br>609377<br>609378<br>609379<br>609380<br>609381 | C<br>C<br>C<br>A<br>C<br>G<br>G | 319<br>7253<br>7249<br>19015<br>547<br>307<br>190 | 609424<br>609425<br>609426<br>609427<br>609428<br>609429<br>609430 | T<br>C<br>G<br>C<br>A<br>G<br>T | 532<br>1414<br>2553<br>7448<br>1854<br>210<br>10 |

Fig. 37J

| sRNA | Strand | Size mature form | Region of interest | Reads | Coverage (%) | Sequence | 5' end read number | | 3' end read number | |
|---|---|---|---|---|---|---|---|---|---|---|
| | | | | | | *N. meningitidis* AZ2491 (NC_003116.1), total mapped reads: 13110087 | | | | |
| | | crRNA16 | 50 609444 | 609493 | 42398 | 0,3234 | AATAATAACCAATACACGAHGTTAAGTTGTTA | 609441 | A 8 | 609490 T 579 |
| | | | | | | | GCTCCCTTTCTCATTTCGCAGT | 609442 | A 548 | 609491 C 2197 |
| | | | | | | | | 609443 | A 3686 | 609492 G 6466 |
| | | | | | | | | 609444 | A 4638 | 609493 C 13217 |
| | | | | | | | | 609445 | T 1428 | 609494 A 2438 |
| | | | | | | | | 609446 | A 2861 | 609495 G 200 |
| | | | | | | | | 609447 | A 1322 | 609496 T 12 |
| | | | | | | | | 609448 | T 287 | |
| tracrRNA → | | tracrRNA1 | 163 614162 | 614324 | 208318 | 1,5890 | TTGTCTTATTTATTACAAATAGATTATTGAC | 614158 | C 1 | 614319 G 311 |
| | | tracrRNA2 | 100 614225 | 614324 | | | TTAHCATCTCACAACGGCTAGAATCCCAAACA | 614161 | A 1 | 614320 G 109 |
| | | tracrRNA3 | 82 614243 | 614324 | | | TATTGTCGCACTGCGAAHGAGAACCGHTGCT | 614162 | T 2 | 614321 G 258 |
| | | | | | | | ACAATAGGCCGHTCGAAAAGATGTGCCGCAA | 614164 | G 1 | 614322 G 150 |
| | | | | | | | CGCTCTGCCCCTGCCCCTTAAGCTTCTGCTTTAAGGG | 614223 | A 596 | 614323 C 41244 |
| | | | | | | | GCATCGTTTAT | 614224 | C 39 | 614324 A 128531 |
| | | | | | | | | 614225 | A 14761 | 614325 T 167 |
| | | | | | | | | 614226 | T 169 | 614326 C 4197 |
| | | | | | | | | 614227 | A 276 | 614327 G 36 |
| | | | | | | | | 614239 | C 208 | 614328 T 122 |
| | | | | | | | | 614240 | G 42037 | 614329 T 865 |
| | | | | | | | | 614241 | A 39965 | 614330 T 1132 |
| | | | | | | | | 614242 | A 22890 | 614331 A 1061 |
| | | | | | | | | 614243 | A 51186 | 614332 T 2788 |
| | | | | | | | | 614244 | T 17711 | 614333 T 3758 |
| | | | | | | | | 614245 | G 4192 | 614334 T 77 |
| | | | | | | | | 614246 | A 488 | 614335 C 18 |
| | | | | | | | | | | 614336 G 3 |
| | | | | | | | | | | 614337 G 3 |
| | | | | | | | | | | 614338 T 1 |

Fig. 37K

| sRNA | Strand | Size mature form | Region of interest | Reads | Coverage (%) | Sequence | 5' end read number | | 3' end read number | |
|---|---|---|---|---|---|---|---|---|---|---|
| crRNA 10 spacers | ← | *L. innocua* Clip11262 (NC_003212.1), total mapped reads: 161865 (Note: low quality of the RNA library) | | | | | | | | |
| crRNA1 | | 35 | 2769606 2769640 | 2 | 0,0012 | GGTAACTTTGCCTAGGATAGTTTTAGAGCTAT GTT | 2769640 | G | 1 2769606 | T |
| crRNA2 | | 22 | 2769540 2769561 | 2 | 0,0012 | CATTTATGTTTTAGAGCTATGTT | 2769561 2769560 | C A | 1 2769540 1 | T |
| crRNA3 | | 24 | 2769468 2769491 | 3 | 0,0019 | GAGTTTTAGAGCTATGTTATTTTG | 2769491 | G | 3 2769468 | G |
| crRNA4 | | 27 | 2769402 2769428 | 7 | 0,0043 | TTATAGTTTTAGAGCTATGTTATTTTG | 2769428 2769427 | T T | 5 2769407 2 2769406 2769405 2769403 2769402 | A T T T G |
| crRNA5 | | 26 | 2769337 2769362 | 5 | 0,0031 | TAAATGTTTTAGAGCTATGTTATTTT | 2769362 2769360 | T A | 3 2769339 2 2769337 | T T |
| crRNA8 | | 23 | 2769142 2769164 | 2 | 0,0012 | TACAAGTTTTAGAGCTATGTTAT | 2769164 3769163 | T A | 1 2769143 1 2769142 | A T |
| crRNA9 | | 30 | 2769072 2769101 | 19 | 0,0017 | TTCATGTTGTTTTAGAGCTATGTTATTTTTG | 2769101 2769100 2769099 2769098 2769097 2769096 | T T C A T G | 6 2769079 1 2769078 4 2769075 3 2769073 3 2769072 2 | T T T T G |
| crRNA10 | | 28 | 2769000 2769027 | 19 | 0,0017 | GTTTTAGAGCTATGCTATTTCGAATACT | 2769027 | G | 1 2769000 | T |

Fig. 37L

| sRNA | Strand | Size mature form | Region of interest | Reads | Coverage (%) | Sequence | 5' end read number | 3' end read number |
|---|---|---|---|---|---|---|---|---|
| | | | | | | *L. innocua* Clip11262 (NC_003212.1), total mapped reads: 161865 (Note: low quality of the RNA library) | | |
| tracrRNA → | tracrRNA1 | 90 | 2774774  2774863 | 367 | 0.2267 | ATTGTTAGTATTCAAATAACATAGCAAGTTA | 2774774  A  34 | 2774861  T  2 |
| | tracrRNA2 | 76 | 2774788  2774863 | | | AAATAAGGCTTGTCCGTTATCAACTTTTAAT | 2774783  A  1 | 2774862  T  47 |
| | tracrRNA3 | 68 | 2774796  2774863 | | | TAAGTAGCGCTGTTTCGGGCGTTTTTT | 2774786  C  1 | 2774863  T  150 |
| | | | | | | | 2774787  A  1 | 2774864  T  67 |
| | | | | | | | 2774788  A  22 | 2774865  T  30 |
| | | | | | | | 2774794  C  1 | 2774866  G  15 |
| | | | | | | | 2774795  A  1 | 2774867  T  6 |
| | | | | | | | 2774796  T  5 | |
| | | | | | | | 2774797  A  2 | |
| | | | | | | | 2774799  C  5 | |
| | | | | | | | 2774801  A  1 | |

Fig. 37M

| sRNA | Strand | Size mature form | Region of interest | | Reads | Coverage (%) | Sequence | 5' end read number | | | 3' end read number | | |
|---|---|---|---|---|---|---|---|---|---|---|---|---|---|
| | | | colspan | | | | S. mutans UA159 (NC_004350.2), total mapped reads: 1542239 | | | | | | |
| crRNA 5 spacers | ← | crRNA1 | 38 | 1328162 1328199 | 267104 | 17,3192 | GCCATTAATTAATAATGGTGAGTTTAGAGCTG TGTTGTTTCGA | 1328201 | A | 8 | 1328166 | G | 18547 |
| | | | | | | | | 1328200 | C | 178 | 1328165 | T | 41345 |
| | | | | | | | | 1328199 | G | 264047 | 1328164 | T | 53386 |
| | | | | | | | | 1328198 | C | 191 | 1328163 | G | 9084 |
| | | | | | | | | 1328197 | C | 167 | 1328162 | T | 59197 |
| | | | | | | | | 1328196 | A | 117 | 1328161 | T | 28333 |
| | | | | | | | | | | | 1328160 | T | 4240 |
| | | | | | | | | | | | 1328159 | C | 18236 |
| | | | | | | | | | | | 1328158 | G | 26742 |
| | | | | | | | | | | | 1328157 | A | 5573 |
| | | | | | | | | | | | 1328156 | A | 17 |
| | | crRNA2 | 36 | 1328098 1328133 | 26578 | 1,7233 | GCTAGCCGCAGTTAGTGCTCTGTTTAAGAGCTG TGTTGTTTCGA | 1328135 | C | 4 | 1328101 | T | 37 |
| | | | | | | | | 1328134 | A | 13 | 1328100 | G | 800 |
| | | | | | | | | 1328133 | G | 25656 | 1328099 | T | 6395 |
| | | | | | | | | 1328132 | C | 212 | 1328098 | T | 11256 |
| | | | | | | | | 1328131 | T | 25 | 1328097 | G | 301 |
| | | | | | | | | 1328130 | A | 62 | 1328096 | T | 1453 |
| | | | | | | | | 1328129 | G | 25 | 1328095 | T | 1755 |
| | | | | | | | | | | | 1328094 | T | 447 |
| | | | | | | | | | | | 1328093 | C | 1302 |
| | | | | | | | | | | | 1328092 | G | 1996 |
| | | | | | | | | | | | 1328091 | A | 670 |
| | | | | | | | | | | | 1328090 | A | 5 |

Fig. 37N

| sRNA | Strand | Size mature form | Region of interest | Reads | Coverage (%) | Sequence | 5' end read number | | 3' end read number | |
|---|---|---|---|---|---|---|---|---|---|---|
| | | | | | | *S. mutans UA159* (NC_004350.2), total mapped reads: 1542239 | | | | |
| crRNA3 | | 34 | 1328034 1328134 | 138067 | 8,9567 | TGTGTGTCATCATAGTTAGGTTTAGAGCTG TGTTGTTTCGA | 1328069 G 4 | 1328036 G 2880 |
| | | | | | | | 1328068 C 66 | 1328035 T 733 |
| | | | | | | | 1328067 T 134361 | 1328034 G 68203 |
| | | | | | | | 1328066 G 609 | 1328033 T 37212 |
| | | | | | | | 1328065 T 321 | 1328032 T 24528 |
| | | | | | | | | 1328031 G 1003 |
| | | | | | | | | 1328030 T 889 |
| | | | | | | | | 1328029 T 610 |
| | | | | | | | | 1328028 T 124 |
| | | | | | | | | 1328027 C 371 |
| | | | | | | | | 1328026 G 546 |
| | | | | | | | | 1328025 A 145 |
| crRNA4 | | 35 | 1327967 1328001 | 104705 | 6,7892 | CAATTAGACAATTAGACAAACGTTTTAGAGCTG TGTTGTTTCGA | 1328003 T 8 | 1328969 T 348 |
| | | | | | | | 1328002 T 36 | 1328968 G 8606 |
| | | | | | | | 1328001 C 101017 | 1328967 T 59863 |
| | | | | | | | 1328000 A 681 | 1328966 T 25845 |
| | | | | | | | 1327999 A 216 | 1328965 G 756 |
| | | | | | | | | 1328964 T 3053 |
| | | | | | | | | 1328963 T 1433 |
| | | | | | | | | 1328962 T 1602 |
| | | | | | | | | 1328961 C 864 |
| | | | | | | | | 1328960 G 839 |
| | | | | | | | | 1328959 A 322 |

Fig. 37O

| sRNA | Strand | Size mature form | Region of interest | | Reads | Coverage (%) | Sequence | 5' end read number | | 3' end read number | |
|---|---|---|---|---|---|---|---|---|---|---|---|
| | | | | | | | *S. mutans UA159* (NC_004350.2), total mapped reads: 1542239 | | | | |
| | | crRNA5 | 37 | 1327899 1327935 | 63999 | 4,1497 | TTCGGACATGACTTGCCACAGTTTAGAGCTG TGTTGTTATCGA | 1327940<br>1327937<br>1327936<br>1327935<br>1327934<br>1327933<br>1327932<br>1327931 | A<br>T<br>A<br>T<br>T<br>C<br>G<br>G | 4<br>6<br>17<br>62587<br>1029<br>108<br>19<br>36 | 1327902<br>1327901<br>1327900<br>1327899<br>1327898<br>1327897<br>1327896<br>1327895<br>1327894<br>1327893 | G<br>T<br>T<br>G<br>T<br>T<br>T<br>C<br>G<br>A | 902<br>3296<br>12381<br>19843<br>2864<br>14180<br>2061<br>2079<br>5259<br>630 |
| tracrRNA → | | tracrRNA1<br>tracrRNA2<br>tracrRNA3 | 102<br>88<br>80 | 1335040 1335141<br>1335054 1335141<br>1335062 1335141 | 1299 | 0,0842 | GTTGGAATCATTCGAAACAACACAGCAAGTTA AARTAAGGCAGTGATTTTTAATCCAGTCCGTA CACAACTTGAAAAAGTGCGCACCGATTCGGTG CTTTTTTATTT | 1335038<br>1335040<br>1335041<br>1335042<br>1335051<br>1335053<br>1335054<br>1335055<br>1335057<br>1335058<br>1335062<br>1335063 | G<br>G<br>T<br>T<br>T<br>G<br>A<br>A<br>C<br>A<br>C<br>A | 1<br>466<br>6<br>1<br>4<br>3<br>415<br>2<br>1<br>1<br>186<br>15 | 1335140<br>1335141<br>1335142<br>1335143<br>1335144<br>1335145<br>1335146<br>1335149 | T<br>T<br>T<br>A<br>T<br>T<br>T<br>T | 13<br>64<br>29<br>13<br>6<br>13<br>1<br>1 |

Fig. 38A

| Cluster | SEQ ID NO: |
|---|---|
| 1 | 2, 3, 4, 5, 6, 7, 8, 15, 23, 24, 25, 36, 37, 38, 39, 41, 71, 74, 105, 116, 136, 138, 166, 177, 180, 183, 193, 204, and 232 |
| 2 | 83, 75, 156, 96, 121, 235, 208, 127, 182, 134, 119, 246, 153, 202 |
| 3 | 101, 168, 48, 226, 216, 210, 120, 102, 176, 57, 108, 79, 1, 245 |
| 4 | 219, 135, 53, 62, 240, 165, 217, 82, 212, 19, 40, 18, 194 |
| 5 | 84, 21, 150, 221, 111, 76, 47, 59, 77, 112, 198, 147 |
| 6 | 90, 91, 214, 92, 152, 98, 243, 197, 32, 227, 162 |
| 7 | 103, 187, 223, 151, 158, 126 |
| 8 | 88, 167, 13, 164, 184, 123 |
| 9 | 58, 73, 195, 148, 31, 33 |
| 10 | 206, 188, 211, 161, 205, 44 |

| Cluster | SEQ ID NO: |
|---|---|
| 11 | 50, 54, 78, 106, 174 |
| 12 | 209, 220, 146, 157 |
| 13 | 70, 154, 100, 117 |
| 14 | 128, 144, 118, 129 |
| 15 | 131, 66, 149, 145 |
| 16 | 89, 169, 163 |
| 17 | 141, 49, 72 |
| 18 | 196, 114, 86 |

| Cluster | SEQ ID NO: |
|---|---|
| 19 | 55, 27, 215 |
| 20 | 228, 234 |
| 21 | 160, 213 |
| 22 | 207, 237 |
| 23 | 230, 94 |
| 24 | 200, 247 |
| 25 | 133, 143 |
| 26 | 64, 68 |
| 27 | 20, 45 |
| 28 | 60, 56 |
| 29 | 99, 52 |

Fig. 38B

| Cluster | SEQ ID NO: | Cluster | SEQ ID NO: | Cluster | SEQ ID NO: |
|---|---|---|---|---|---|
| 30 | 244, 185 | 45 | 233 | 59 | 218 |
| 31 | 43 | 46 | 122 | 60 | 65 |
| 32 | 189 | 47 | 16 | 61 | 171 |
| 33 | 170 | 48 | 242 | 62 | 97 |
| 34 | 11 | 49 | 203 | 63 | 63 |
| 35 | 107 | 50 | 26 | 64 | 46 |
| 36 | 14 | 51 | 137 | 65 | 225 |
| 37 | 236 | 52 | 199 | 66 | 10 |
| 38 | 12 | 53 | 34 | 67 | 173 |
| 39 | 17 | 54 | 201 | 68 | 51 |
| 40 | 239 | 55 | 178 | 69 | 142 |
| 41 | 61 | 56 | 42 | 70 | 69 |
| 42 | 85 | 57 | 190 | 71 | 28 |
| 43 | 191 | 58 | 81 | 72 | 139 |
| 44 | 22 | | | 73 | 80 |
| | | | | 74 | 172 |
| | | | | 75 | 115 |
| | | | | 76 | 229 |
| | | | | 77 | 175 |
| | | | | 78 | 181 |

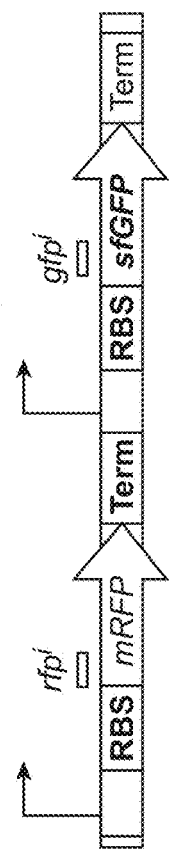
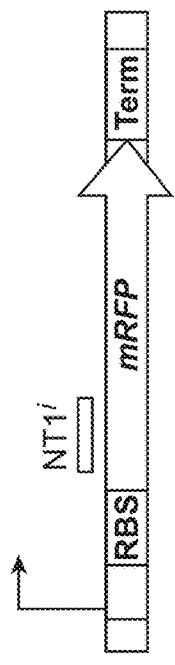
Fig. 42A Single gene specificity
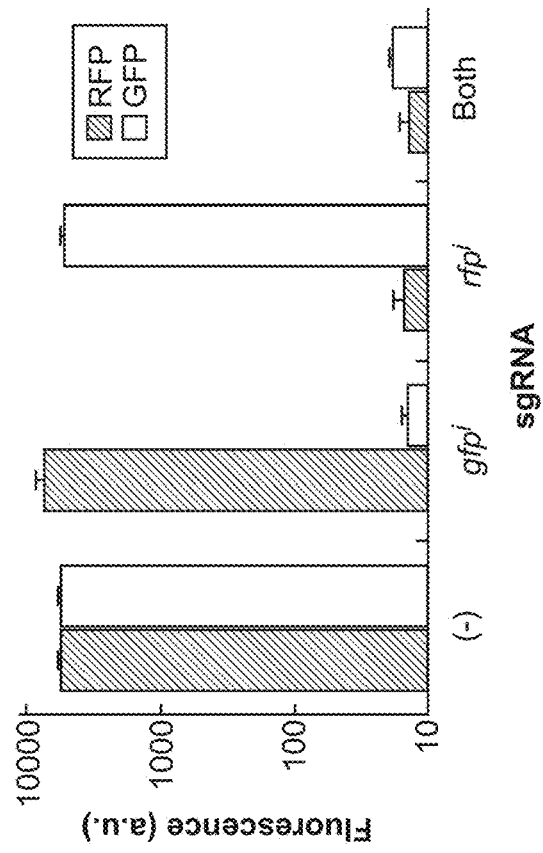
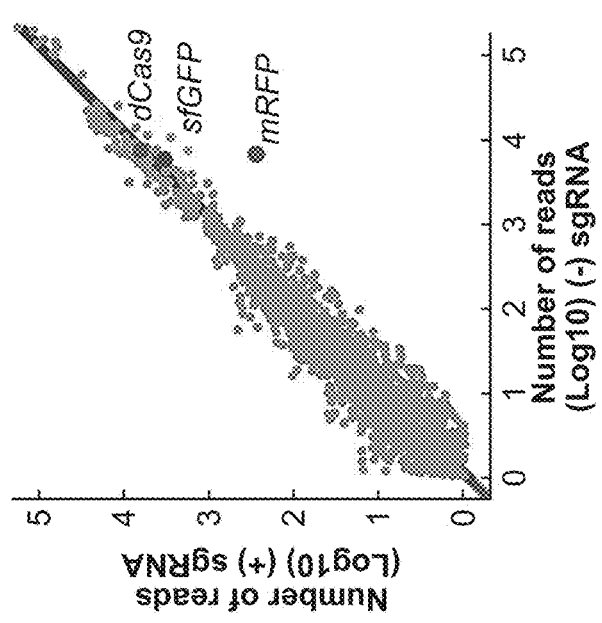
Fig. 42B Two gene specificity

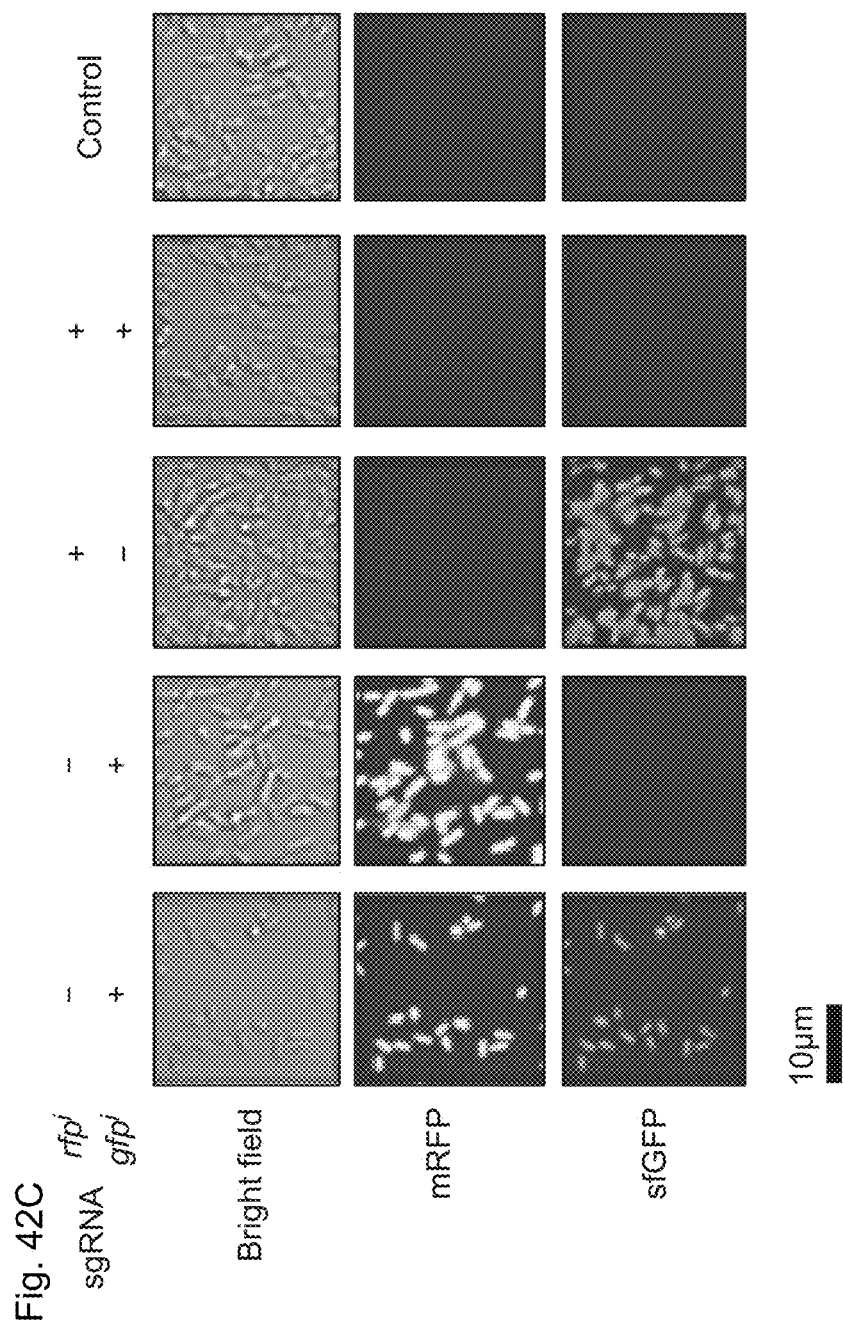

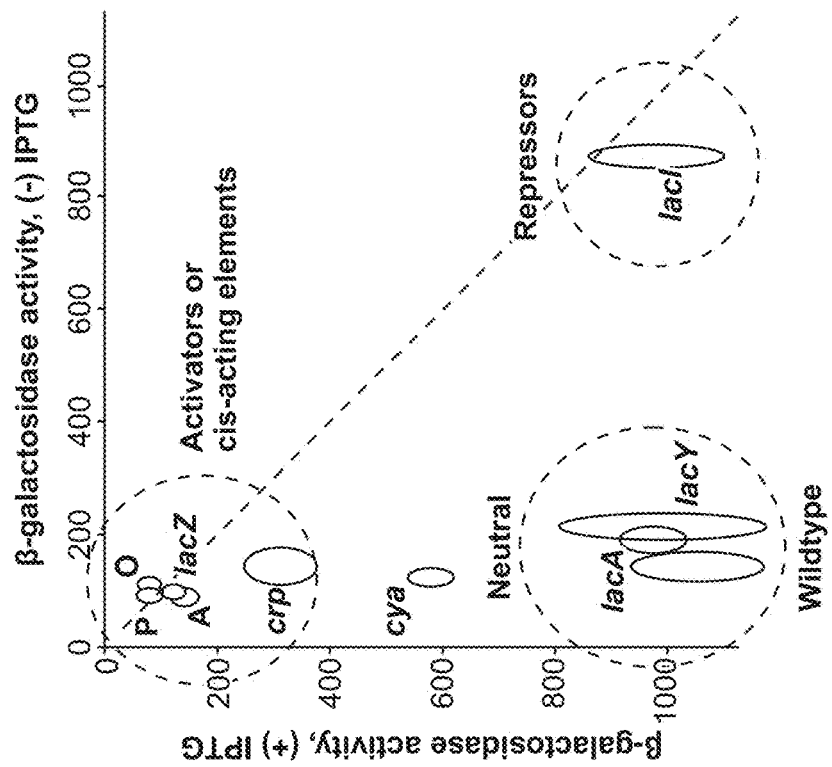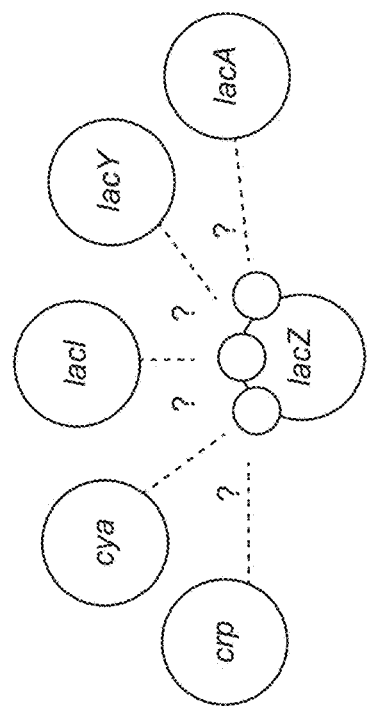
Fig. 44C

Fig. 45A
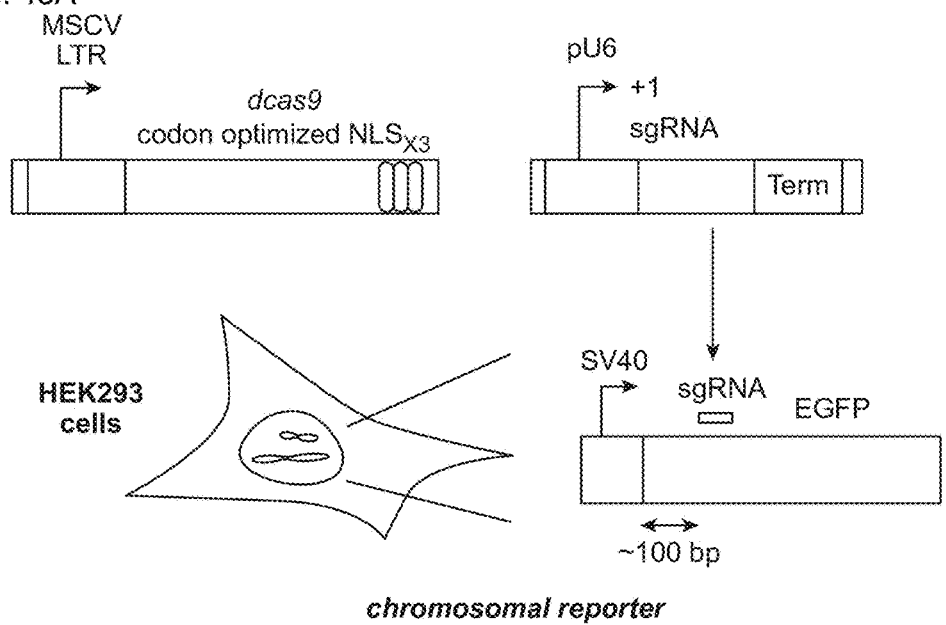
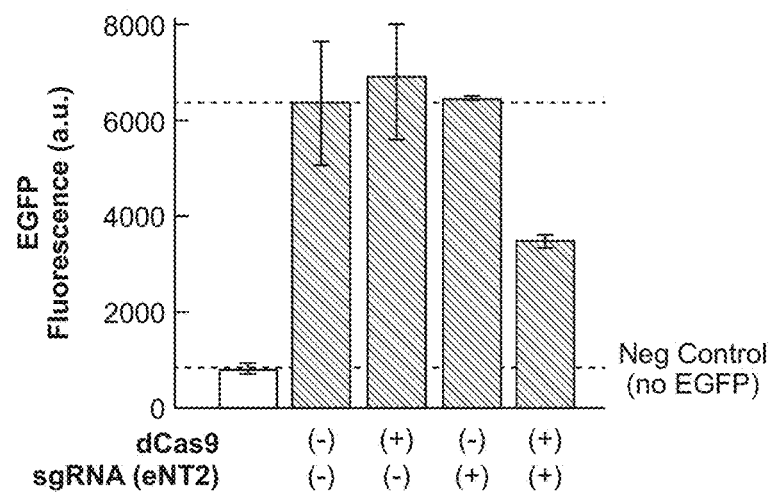

Fig. 45B
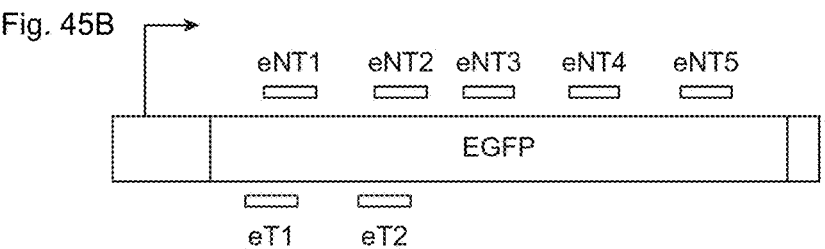
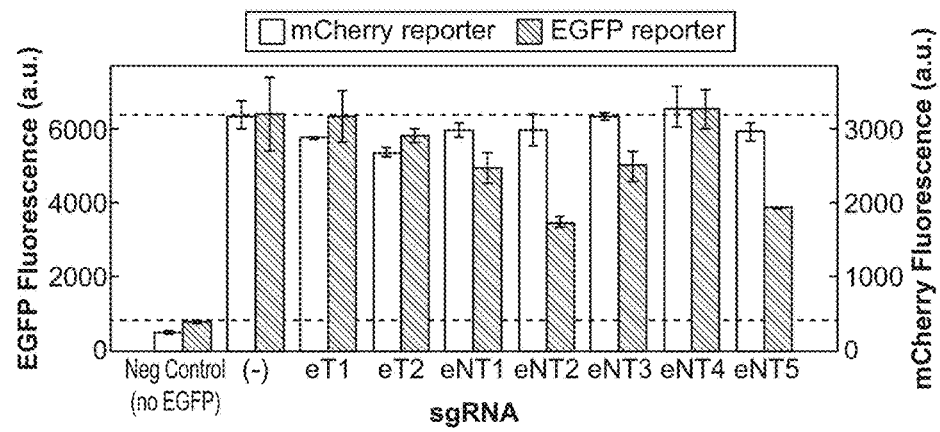

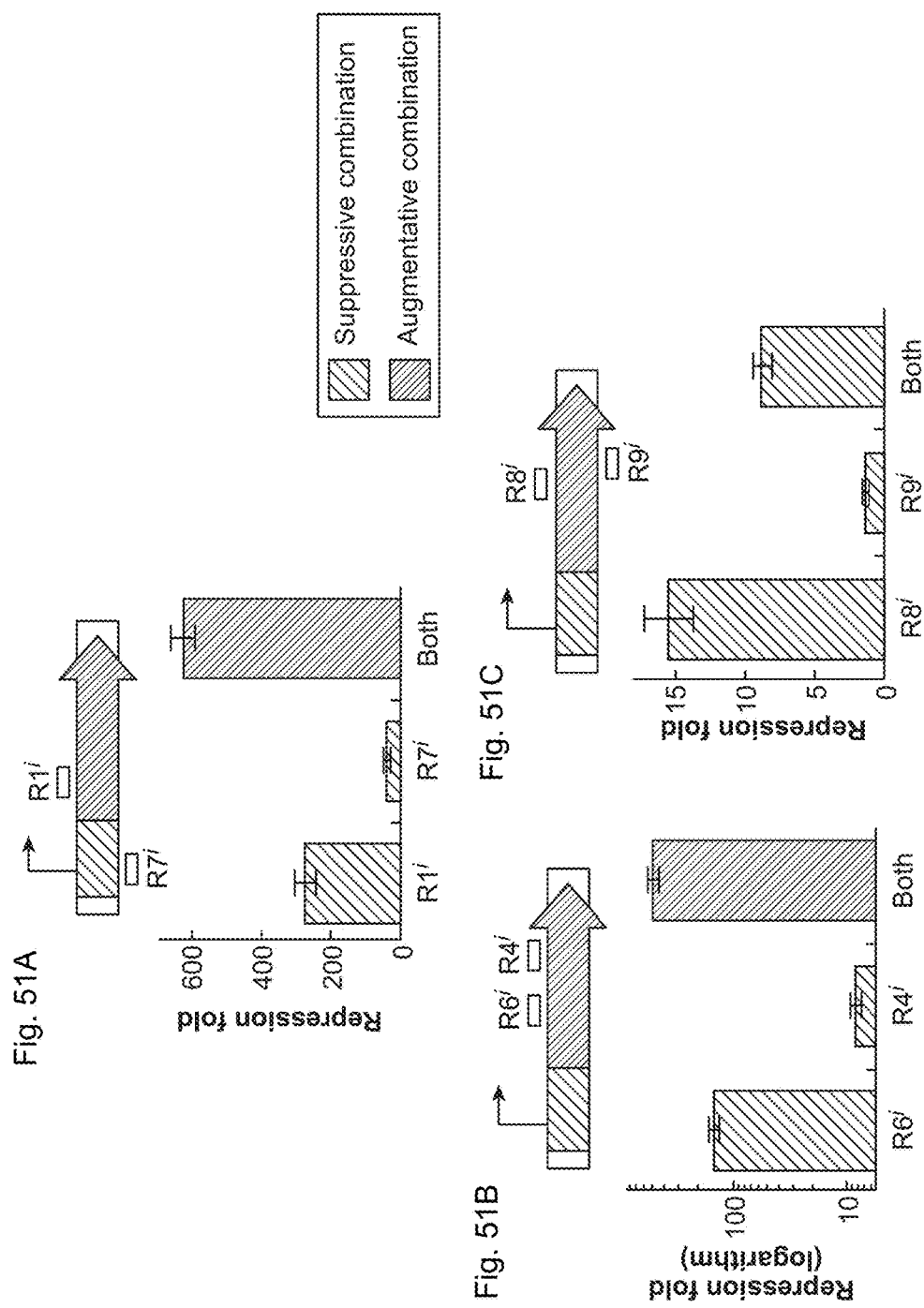

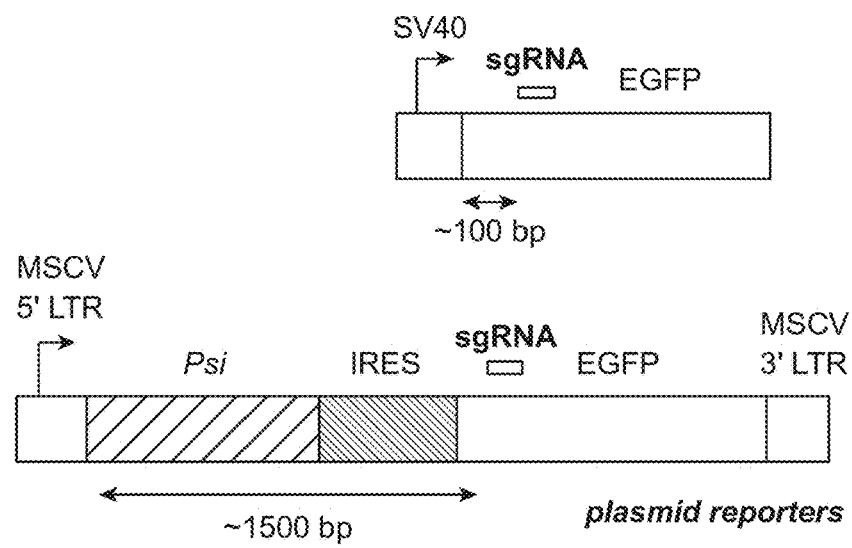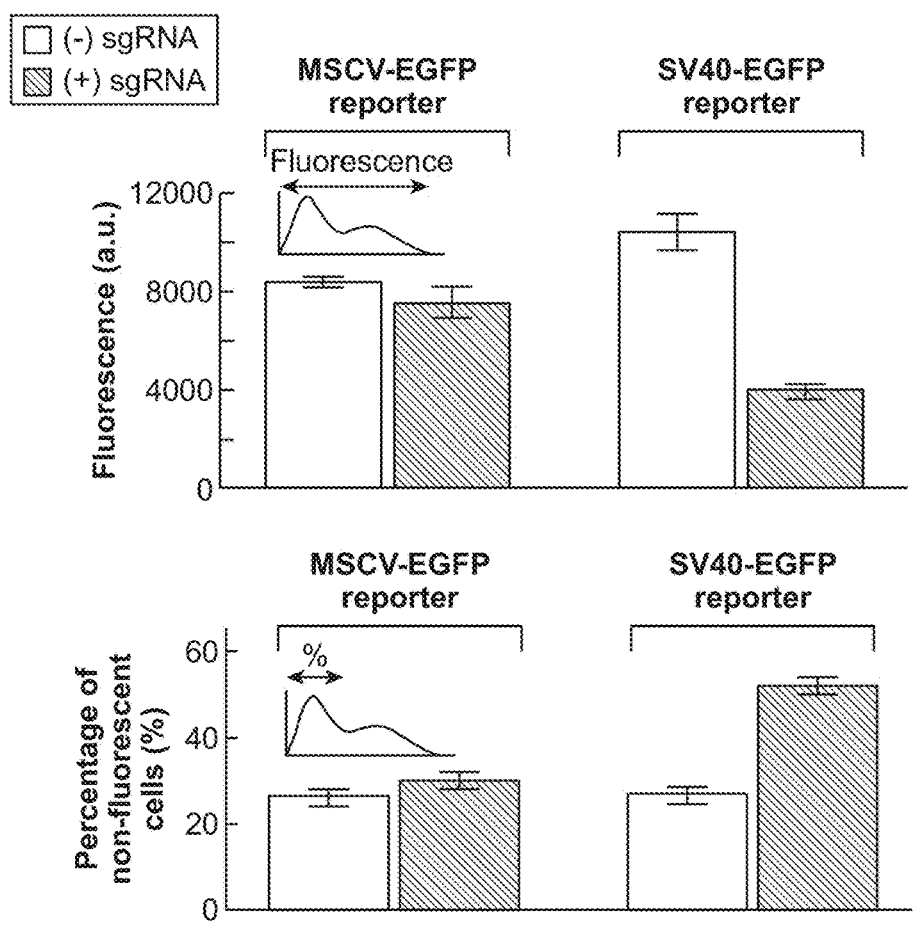
FIG. 52

Fig. 54A

| Protein name | Function |
|---|---|
| Transcriptional Activators | |
| GAL4 | Transcription activation |
| VP16 | Transcription activation |
| VP64 | Transcription activation |
| p65 subdomain (NFkB) | Transcription activation |
| Transcriptional repressors | |
| KRAB | Transcription repression |
| Mad mSIN3 interaction domain (SID) | Transcription repression |
| the ERF repressor domain (ERD) | Transcription repression |
| Histone lysine methyltransferases (KMT) | |
| KMT1 family: SUV39H1, SUV39H2, G9A, ESET/SETDB1, and homologs (Clr4, Su(var)3-9) | Heterochromatin formation/ transcription repression |
| KMT2 family: hSET1A, hSET1B, MLL1 to 5, ASH1, and homologs (Trx, Trr, Ash1) | Transcription activation |
| KMT3 family: SYMD2, NSD1 | Transcription activation |
| KMT4: DOT1L and homologs | Transcription activation |
| KMT5 family: Pr-SET7/8, SUV4-20H1, and homologs (PR-set7, Suv4-20, Set9) | DNA damage response, transcription repression |
| KMT6: EZH2 | Polycomb silencing |
| KMT8: RIZ1 | Transcription repression |
| Histone lysine demethylates (KDM) | |
| KDM1: LSD1/BHC110 and homologs (SpLsd1/Swm1/Saf110, Su(var)3-3) | Transcription activation and repression, heterochromatin formation |
| KDM3 family: JHDM2a/b | Androgen receptor gene activation, spermatogenesis |
| KDM4 family: JMJD2A/JHDM3A, JMJD2B, JMJD2C/GASC1, JMJD2D, and homologs (Rph1) | Transcription elongation, transcription repression, heterochromatin formation, genome integrity |
| KDM5 family: JARID1A/RBP2, JARID1B/PLU-1, JARID1C/SMCX, JARID1D/SMCY, and homologs (Lid, Jhn2, Jmj2) | Transcription repression |
| KDM6 family: UTX, JMJD3 | Transcription activation |

Fig. 54B

| Protein name | Function |
| --- | --- |
| Histone lysine acetyltransferases (KAT) | |
| KAT2 family: hGCN5, PCAF, and homologs (dGCN5/PCAF, Gcn5) | Transcription activation, DNA repair |
| KAT3 family: CBP, p300, and homologs (dCBP/NEJ) | Transcription activation, DNA repair |
| KAT4: TAF1 and homologs (dTAF1) | Transcription activation |
| KAT5: TIP60/PLIP, and homologs | Transcription activation, DNA repair |
| KAT6: MOZ/MYST3, MORF/MYST4, and homologs (Mst2, Sas3, CG1894) | Transcription activation and elongation, DNA replication |
| KAT7: HBO1/MYST2, and homologs (CHM, Mst2) | Transcription, DNA replication |
| KAT8: HMOF/MYST1, and homologs (dMOF, CG1894, Sas2, Mst2) | Chromatin boundaries, dosage compensation, DNA repair |
| KAT13 family: SRC1, ACTR, P160, CLOCK, and homologs | Transcription activation |
| Histone lysine deacetylases | |
| Class I: HDAC1, HDAC2, HDAC3, HDAC8, and its homologs (Rpd3, Hos1, Cir6) | Transcription repression, heterochromatin formation |
| Class IIa: HDAC4, HDAC5, HDAC7, HDAC9, and its homologs (Hda1, Cir3 etc.) | Transcription repression, heterochromatin formation |
| Class III: SIRT1, SIRT2, and its homologs (Sir2, Hst1, Hst2, Hst3, Hst4) | Transcription repression, heterochromatin formation |
| Class IV: HDAC11 | Transcription repression |
| DNA methylases (adenosine or cytosine modification) | |
| Dam (E. coli) | Restriction system |
| Dcm (E. coli) | Restriction system |
| M. SssI (Spiroplasma sp) | Restriction system |
| DNMT1 | Transcription repression, imprinting, heterochromatin formation |
| DNMT3a/DNMT3b, METI, DRM3 (plants), and homologs | Transcription repression, imprinting, heterochromatin formation |
| Chromomethylases e.g. ZMET2, CMT1, CMT2 (plants) | Transcription repression, imprinting, heterochromatin formation |
| DNA demethylases | |
| AID/Apobec deaminase family: AID | Transcription activation, genome integrity |
| TET dioxygenase family: TET1 | Transcription activation, genome integrity |
| DEMETER glycosylase family: DME, DML1, DML2, ROS1 | Transcription activation, genome integrity |

Fig. 54C

| Protein name | Function |
|---|---|
| Boundary elements | |
| CTCF | Chromatin insulation, heterochromatin spreading suppression |
| Periphery recruitment elements | |
| Lamin A | Transcription repression |
| Lamin B | Transcription repression |
| Protein docking elements | |
| FKBP/FRB (S. pombe) | rapamycin dependent recruitment |
| Pil1/Aby1 (E. coli) | ABA dependent recruitment |

HEK293 cells with a GAL4 chromosome reporter

METHODS AND COMPOSITIONS FOR RNA-DIRECTED TARGET DNA MODIFICATION AND FOR RNA-DIRECTED MODULATION OF TRANSCRIPTION

CROSS-REFERENCE

This application is a continuation of U.S. patent application Ser. No. 13/842,859, filed Mar. 15, 2013, which claims the benefit of U.S. Provisional Patent Application Nos. 61/652,086 filed May 25, 2012, 61/716,256 filed Oct. 19, 2012, 61/757,640 filed Jan. 28, 2013, and 61/765,576, filed Feb. 15, 2013, each of which applications is incorporated herein by reference in its entirety.

INCORPORATION BY REFERENCE OF SEQUENCE LISTING PROVIDED AS A TEXT FILE

A Sequence Listing is provided herewith as a text file, "BERK-187-SeqList_ST25.txt" created on Mar. 14, 2013 and having a size of 7645 KB. The contents of the text file are incorporated by reference herein in their entirety.

BACKGROUND

About 60% of bacteria and 90% of archaea possess CRISPR (clustered regularly interspaced short palindromic repeats)/CRISPR-associated (Cas) system systems to confer resistance to foreign DNA elements. Type II CRISPR system from Streptococcus pyogenes involves only a single gene encoding the Cas9 protein and two RNAs—a mature CRISPR RNA (crRNA) and a partially complementary trans-acting RNA (tracrRNA)—which are necessary and sufficient for RNA-guided silencing of foreign DNAs.

In recent years, engineered nuclease enzymes designed to target specific DNA sequences have attracted considerable attention as powerful tools for the genetic manipulation of cells and whole organisms, allowing targeted gene deletion, replacement and repair, as well as the insertion of exogenous sequences (transgenes) into the genome. Two major technologies for engineering site-specific DNA nucleases have emerged, both of which are based on the construction of chimeric endonuclease enzymes in which a sequence non-specific DNA endonuclease domain is fused to an engineered DNA binding domain. However, targeting each new genomic locus requires the design of a novel nuclease enzyme, making these approaches both time consuming and costly. In addition, both technologies suffer from limited precision, which can lead to unpredictable off-target effects.

The systematic interrogation of genomes and genetic reprogramming of cells involves targeting sets of genes for expression or repression. Currently the most common approach for targeting arbitrary genes for regulation is to use RNA interference (RNAi). This approach has limitations. For example, RNAi can exhibit significant off-target effects and toxicity.

There is need in the field for a technology that allows precise targeting of nuclease activity (or other protein activities) to distinct locations within a target DNA in a manner that does not require the design of a new protein for each new target sequence. In addition, there is a need in the art for methods of controlling gene expression with minimal off-target effects.

SUMMARY

The present disclosure provides a DNA-targeting RNA that comprises a targeting sequence and, together with a modifying polypeptide, provides for site-specific modification of a target DNA and/or a polypeptide associated with the target DNA. The present disclosure further provides site-specific modifying polypeptides. The present disclosure further provides methods of site-specific modification of a target DNA and/or a polypeptide associated with the target DNA The present disclosure provides methods of modulating transcription of a target nucleic acid in a target cell, generally involving contacting the target nucleic acid with an enzymatically inactive Cas9 polypeptide and a DNA-targeting RNA. Kits and compositions for carrying out the methods are also provided. The present disclosure provides genetically modified cells that produce Cas9; and Cas9 transgenic non-human multicellular organisms.

Features

Features of the present disclosure include a DNA-targeting RNA comprising: (i) a first segment comprising a nucleotide sequence that is complementary to a sequence in a target DNA; and (ii) a second segment that interacts with a site-directed modifying polypeptide. In some cases, the first segment comprises 8 nucleotides that have 100% complementarity to a sequence in the target DNA. In some cases, the second segment comprises a nucleotide sequence with at least 60% identity over a stretch of at least 8 contiguous nucleotides to any one of the nucleotide sequences set forth in SEQ ID NOs:431-682 (e.g., 431-562). In some cases, the second segment comprises a nucleotide sequence with at least 60% identity over a stretch of at least 8 contiguous nucleotides to any one of the nucleotide sequences set forth in SEQ ID NOs:563-682. In some cases, the site-directed modifying polypeptide comprises an amino acid sequence having at least about 75% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346.

Features of the present disclosure include a DNA polynucleotide comprising a nucleotide sequence that encodes the DNA-targeting RNA. In some cases, a recombinant expression vector comprises the DNA polynucleotide. In some cases, the nucleotide sequence encoding the DNA-targeting RNA is operably linked to a promoter. In some cases, the promoter is an inducible promoter. In some cases, the nucleotide sequence encoding the DNA-targeting RNA further comprises a multiple cloning site. Features of the present disclosure include an in vitro genetically modified host cell comprising the DNA polynucleotide.

Features of the present disclosure include a recombinant expression vector comprising: (i) a nucleotide sequence encoding a DNA-targeting RNA, wherein the DNA-targeting RNA comprises: (a) a first segment comprising a nucleotide sequence that is complementary to a sequence in a target DNA; and (b) a second segment that interacts with a site-directed modifying polypeptide; and (ii) a nucleotide sequence encoding the site-directed modifying polypeptide comprising: (a) an RNA-binding portion that interacts with the DNA-targeting RNA; and (b) an activity portion that exhibits site-directed enzymatic activity, wherein the site of enzymatic activity is determined by the DNA-targeting RNA.

Features of the present disclosure include a recombinant expression vector comprising: (i) a nucleotide sequence encoding a DNA-targeting RNA, wherein the DNA-targeting RNA comprises: (a) a first segment comprising a nucleotide sequence that is complementary to a sequence in a target DNA; and (b) a second segment that interacts with a site-directed modifying polypeptide; and (ii) a nucleotide sequence encoding the site-directed modifying polypeptide, where the site-directed modifying polypeptide comprises: (a) an RNA-binding portion that interacts with the DNA-targeting RNA; and (b) an activity portion that modulates transcription within the target DNA, wherein the site of modulated transcription within the target DNA is determined by the DNA-targeting RNA.

Features of the present disclosure include a variant site-directed modifying polypeptide comprising: (i) an RNA-binding portion that interacts with a DNA-targeting RNA, wherein the DNA-targeting RNA comprises a nucleotide sequence that is complementary to a sequence in a target DNA; and (ii) an activity portion that exhibits reduced site-directed enzymatic activity, wherein the site of enzymatic activity is determined by the DNA-targeting RNA. In some cases, the variant site-directed modifying polypeptide comprises an H840A mutation of the S. pyogenes sequence SEQ ID NO:8 or the corresponding mutation in any of the amino acid sequences set forth as SEQ ID NOs:1-256 and 795-1346. In some cases, the variant site-directed modifying polypeptide comprises a D10A mutation of the S. pyogenes sequence SEQ ID NO:8 or the corresponding mutation in any of the amino acid sequences set forth as SEQ ID NOs:1-256 and 795-1346. In some cases, the variant site-directed modifying polypeptide comprises both (i) a D10A mutation of the S. pyogenes sequence SEQ ID NO:8 or the corresponding mutation in any of the amino acid sequences set forth as SEQ ID NOs:1-256 and 795-1346; and (ii) an H840A mutation of the S. pyogenes sequence SEQ ID NO:8 or the corresponding mutation in any of the amino acid sequences set forth as SEQ ID NOs:1-256 and 795-1346.

Features of the present disclosure include a chimeric site-directed modifying polypeptide comprising: (i) an RNA-binding portion that interacts with a DNA-targeting RNA, wherein the DNA-targeting RNA comprises a nucleotide sequence that is complementary to a sequence in a target DNA; and (ii) an activity portion that exhibits site-directed enzymatic activity, wherein the site of enzymatic activity is determined by the DNA-targeting RNA. In some cases, the chimeric site-directed modifying polypeptide of comprises an amino acid sequence having at least about 75% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346. In some cases, the DNA-targeting RNA further comprises a nucleotide sequence with at least 60% identity over a stretch of at least 8 contiguous nucleotides to any one of the nucleotide sequences set forth in SEQ ID NOs:431-682 (e.g., SEQ ID NOs:563-682). In some cases, the DNA-targeting RNA further comprises a nucleotide sequence with at least 60% identity over a stretch of at least 8 contiguous nucleotides to any one of the nucleotide sequences set forth in SEQ ID NOs:431-562. In some cases, the enzymatic activity of the chimeric site-directed modifying polypeptide modifies the target DNA. In some cases, the enzymatic activity of the chimeric site-directed modifying polypeptide is nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity.

In some cases, the enzymatic activity of the chimeric site-directed modifying polypeptide is nuclease activity. In some cases, the nuclease activity introduces a double strand break in the target DNA. In some cases, the enzymatic activity of the chimeric site-directed modifying polypeptide modifies a target polypeptide associated with the target DNA. In some cases, the enzymatic activity of the chimeric site-directed modifying polypeptide is methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity.

Features of the present disclosure include a polynucleotide comprising a nucleotide sequence encoding a chimeric site-directed modifying polypeptide. In some cases, the polynucleotide is an RNA polynucleotide. In some cases, the polynucleotide is a DNA polynucleotide. Features of the present disclosure include a recombinant expression vector comprising the polynucleotide. In some cases, the polynucleotide is operably linked to a promoter. In some cases, the promoter is an inducible promoter. Features of the present disclosure include an in vitro genetically modified host cell comprising the polynucleotide.

Features of the present disclosure include a chimeric site-directed modifying polypeptide comprising: (i) an RNA-binding portion that interacts with a DNA-targeting RNA, wherein the DNA-targeting RNA comprises a nucleotide sequence that is complementary to a sequence in a target DNA; and (ii) an activity portion that modulates transcription within the target DNA, wherein the site of modulated transcription within the target DNA is determined by the DNA-targeting RNA. In some cases, the activity portion increases transcription within the target DNA. In some cases, the activity portion decreases transcription within the target DNA.

Features of the present disclosure include a genetically modified cell comprising a recombinant site-directed modifying polypeptide comprising an RNA-binding portion that interacts with a DNA-targeting RNA; and an activity portion that exhibits site-directed enzymatic activity, wherein the site of enzymatic activity is determined by the DNA-targeting RNA. In some cases, the site-directed modifying polypeptide comprises an amino acid sequence having at least about 75% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346. In some cases, the cell is selected from the group consisting of: an archaeal cell, a bacterial cell, a eukaryotic cell, a eukaryotic single-cell organism, a somatic cell, a germ cell, a stem cell, a plant cell, an algal cell, an animal cell, in invertebrate cell, a vertebrate cell, a fish cell, a frog cell, a bird cell, a mammalian cell, a pig cell, a cow cell, a goat cell, a sheep cell, a rodent cell, a rat cell, a mouse cell, a non-human primate cell, and a human cell.

Features of the present disclosure include a transgenic non-human organism whose genome comprises a transgene comprising a nucleotide sequence encoding a recombinant site-directed modifying polypeptide comprising: (i) an RNA-binding portion that interacts with a DNA-targeting RNA; and (ii) an activity portion that exhibits site-directed enzymatic activity, wherein the site of enzymatic activity is determined by the DNA-targeting RNA. In some cases, the site-directed modifying polypeptide comprises an amino acid sequence having at least about 75% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346. In some cases, the organism is selected from the group consisting of: an archaea, a bacterium, a eukaryotic single-cell organism, an algae, a plant, an animal, an invertebrate, a fly, a worm, a cnidarian, a vertebrate, a fish, a frog, a bird, a mammal, an ungulate, a rodent, a rat, a mouse, and a non-human primate.

Features of the present disclosure include a composition comprising: (i) a DNA-targeting RNA, or a DNA polynucleotide encoding the same, the DNA-targeting RNA comprising: (a) a first segment comprising a nucleotide sequence that is complementary to a sequence in a target DNA; and (b) a second segment that interacts with a site-directed modifying polypeptide; and (ii) the site-directed modifying polypeptide, or a polynucleotide encoding the same, the site-directed modifying polypeptide comprising: (a) an RNA-binding portion that interacts with the DNA-targeting RNA; and (b) an activity portion that exhibits site-directed enzymatic activity, wherein the site of enzymatic activity is determined by the DNA-targeting RNA. In some cases, the first segment of the DNA-targeting RNA comprises 8 nucleotides that have at least 100% complementarity to a sequence in the target DNA. In some cases, the second segment of the DNA-targeting RNA comprises a nucleotide sequence with at least 60% identity over a stretch of at least 8 contiguous nucleotides to any one of the nucleotide sequences set forth in SEQ ID NOs:431-682 (e.g., SEQ ID NOs:563-682). In some cases, the second segment of the DNA-targeting RNA comprises a nucleotide sequence with at least 60% identity over a stretch of at least 8 contiguous nucleotides to any one of the nucleotide sequences set forth in SEQ ID NOs:431-562. In some cases, the site-directed modifying polypeptide comprises an amino acid sequence having at least about 75% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346. In some cases, the enzymatic activity modifies the target DNA. In some cases, the enzymatic activity is nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity. In some cases, the enzymatic activity is nuclease activity. In some cases, the nuclease activity introduces a double strand break in the target DNA. In some cases, the enzymatic activity modifies a target polypeptide associated with the target DNA. In some cases, the enzymatic activity is methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity. In some cases, the target polypeptide is a histone and the enzymatic activity is methyltransferase activity, demethylase activity, acetyltransferase activity, deacetylase activity, kinase activity, phosphatase activity, ubiquitin ligase activity or deubiquitinating activity. In some cases, the DNA-targeting RNA is a double-molecule DNA-targeting RNA and the composition comprises both a targeter-RNA and an activator-RNA, the duplex-forming segments of which are complementary and hybridize to form the second segment of the DNA-targeting RNA. In some cases, the duplex-forming segment of the activator-RNA comprises a nucleotide sequence with at least 60% identity over a stretch of at least 8 contiguous nucleotides to any one of the nucleotide sequences set forth in SEQ ID NO:SEQ ID NOs:431-682.

Features of the present disclosure include a composition comprising: (i) a DNA-targeting RNA of the present disclosure, or a DNA polynucleotide encoding the same; and (ii) a buffer for stabilizing nucleic acids. Features of the present disclosure include a composition comprising: (i) a site-directed modifying polypeptide of the present disclosure, or a polynucleotide encoding the same; and (ii) a buffer for stabilizing nucleic acids and/or proteins. Features of the present disclosure include a composition comprising: (i) a DNA-targeting RNA, or a DNA polynucleotide encoding the same, the DNA-targeting RNA comprising: (a) a first segment comprising a nucleotide sequence that is complementary to a sequence in a target DNA; and (b) a second segment that interacts with a site-directed modifying polypeptide; and (ii) the site-directed modifying polypeptide, or a polynucleotide encoding the same, the site-directed modifying polypeptide comprising: (a) an RNA-binding portion that interacts with the DNA-targeting RNA; and (b) an activity portion that modulates transcription within the target DNA, wherein the site of modulated transcription within the target DNA is determined by the DNA-targeting RNA. In some cases, the activity portion increases transcription within the target DNA. In some cases, the activity portion decreases transcription within the target DNA. Features of the present disclosure include a composition comprising: (i) a site-directed modifying polypeptide, or a polynucleotide encoding the same; and (ii) a buffer for stabilizing nucleic acids and/or proteins.

Features of the present disclosure include a method of site-specific modification of a target DNA, the method comprising: contacting the target DNA with: (i) a DNA-targeting RNA, or a DNA polynucleotide encoding the same, wherein the DNA-targeting RNA comprises: (a) a first segment comprising a nucleotide sequence that is complementary to a sequence in the target DNA; and (b) a second segment that interacts with a site-directed modifying polypeptide; and (ii) a site-directed modifying polypeptide, or a polynucleotide encoding the same, wherein the site-directed modifying polypeptide comprises: (a) an RNA-binding portion that interacts with the DNA-targeting RNA; and (b) an activity portion that exhibits site-directed enzymatic activity. In some cases, the target DNA is extrachromosomal. In some cases, the target DNA comprises a PAM sequence of the complementary strand that is 5'-CCY-3', wherein Y is any DNA nucleotide and Y is immediately 5' of the target sequence of the complementary strand of the target DNA. In some cases, the target DNA is part of a chromosome in vitro. In some cases, the target DNA is part of a chromosome in vivo. In some cases, the target DNA is part of a chromosome in a cell. In some cases, the cell is selected from the group consisting of: an archaeal cell, a bacterial cell, a eukaryotic cell, a eukaryotic single-cell organism, a somatic cell, a germ cell, a stem cell, a plant cell, an algal cell, an animal cell, in invertebrate cell, a vertebrate cell, a fish cell, a frog cell, a bird cell, a mammalian cell, a pig cell, a cow cell, a goat cell, a sheep cell, a rodent cell, a rat cell, a mouse cell, a non-human primate cell, and a human cell. In some cases, the DNA-targeting RNA comprises a nucleotide sequence with at least 60% identity over a stretch of at least 8 contiguous nucleotides to any one of the nucleotide sequences set forth in SEQ ID NOs:431-682 (e.g., SEQ ID NOs:563-682). In some cases, the DNA-targeting RNA comprises a nucleotide sequence with at least 60% identity over a stretch of at least 8 contiguous nucleotides to any one of the nucleotide sequences set forth SEQ ID NOs:431-562. In some cases, the DNA-modifying polypeptide comprises an amino acid sequence having at least about 75% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346. In some cases, the enzymatic activity modifies the target DNA. In some cases, the enzymatic activity is nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity. In some cases, the DNA-modifying enzymatic activity is nuclease activity. In some cases, the nuclease activity introduces a double strand break in the target DNA. In some cases, the contacting occurs under conditions that are permissive for nonhomologous end joining or homology-directed repair. In some cases, the method further comprises contacting the target DNA with a donor polynucleotide, wherein the donor polynucleotide, a portion of the donor polynucleotide, a copy of the donor polynucleotide, or a portion of a copy of the donor polynucleotide integrates into the target DNA. In some cases, the method does not comprise contacting the cell with a donor polynucleotide, wherein the target DNA is modified such that nucleotides within the target DNA are deleted. In some cases, the enzymatic activity modifies a target polypeptide associated with the target DNA. In some cases, the enzymatic activity is methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity. In some cases, the target polypeptide is a histone and the enzymatic activity is methyltransferase activity, demethylase activity, acetyltransferase activity, deacetylase activity, kinase activity, phosphatase activity, ubiquitin ligase activity or deubiquitinating activity. In some cases, the complex further comprises an activator-RNA. In some cases, the activator-RNA comprises a nucleotide sequence with at least 60% identity over a stretch of at least 8 contiguous nucleotides to any one of the nucleotide sequences set forth in SEQ ID NOs:431-682.

Features of the present disclosure include a method of modulating site-specific transcription within a target DNA, the method comprising contacting the target DNA with: (i) a DNA-targeting RNA, or a DNA polynucleotide encoding the same, wherein the DNA-targeting RNA comprises: (a) a first segment comprising a nucleotide sequence that is complementary to a sequence in the target DNA; and (b) a second segment that interacts with a site-directed modifying polypeptide; and (ii) a site-directed modifying polypeptide, or a polynucleotide encoding the same, wherein the site-directed modifying polypeptide comprises: (a) an RNA-binding portion that interacts with the DNA-targeting RNA; and (b) an activity portion that modulates transcription, wherein said contacting results in modulating transcription within the target DNA. In some cases, transcription within the target DNA is increased. In some cases, transcription within the target DNA is decreased.

Features of the present disclosure include a method of site-specific modification at target DNA, the method comprising: contacting the target DNA with: (i) a DNA-targeting RNA, or a DNA polynucleotide encoding the same, wherein the DNA-targeting RNA comprises: (a) a first segment comprising a nucleotide sequence that is complementary to a sequence in the target DNA; and (b) a second segment that interacts with a site-directed modifying polypeptide; and (ii) a site-directed modifying polypeptide, or a polynucleotide encoding the same, wherein the site-directed modifying polypeptide comprises: (a) an RNA-binding portion that interacts with the DNA-targeting RNA; and (b) an activity portion that modulates transcription within the target DNA. In some cases, the site-directed modifying polypeptide increases transcription within the target DNA. In some cases, the site-directed modifying polypeptide decreases transcription within the target DNA.

Features of the present disclosure include a method of promoting site-specific cleavage and modification of a target DNA in a cell, the method comprising introducing into the cell: (i) a DNA-targeting RNA, or a DNA polynucleotide encoding the same, wherein the DNA-targeting RNA comprises: (a) a first segment comprising a nucleotide sequence that is complementary to a sequence in the target DNA; and (b) a second segment that interacts with a site-directed modifying polypeptide; and (ii) a site-directed modifying polypeptide, or a polynucleotide encoding the same, wherein the site-directed modifying polypeptide comprises: (a) an RNA-binding portion that interacts with the DNA-targeting RNA; and (b) an activity portion that exhibits nuclease activity that creates a double strand break in the target DNA; wherein the site of the double strand break is determined by the DNA-targeting RNA, the contacting occurs under conditions that are permissive for nonhomologous end joining or homology-directed repair, and the target DNA is cleaved and rejoined to produce a modified DNA sequence. In some cases, the method further comprises contacting the target DNA with a donor polynucleotide, wherein the donor polynucleotide, a portion of the donor polynucleotide, a copy of the donor polynucleotide, or a portion of a copy of the donor polynucleotide integrates into the target DNA. In some cases, the method does not comprise contacting the cell with a donor polynucleotide, wherein the target DNA is modified such that nucleotides within the target DNA are deleted. In some cases, the cell is selected from the group consisting of: an archaeal cell, a bacterial cell, a eukaryotic cell, a eukaryotic single-cell organism, a somatic cell, a germ cell, a stem cell, a plant cell, an algal cell, an animal cell, in invertebrate cell, a vertebrate cell, a fish cell, a frog cell, a bird cell, a mammalian cell, a pig cell, a cow cell, a goat cell, a sheep cell, a rodent cell, a rat cell, a mouse cell, a non-human primate cell, and a human cell. In some cases, the cell is in vitro. In some cases, the cell is in vivo.

Features of the present disclosure include a method of producing a genetically modified cell in a subject, the method comprising: (I) introducing into a cell: (i) a DNA-targeting RNA, or a DNA polynucleotide encoding the same, wherein the DNA-targeting RNA comprises: (a) a first segment comprising a nucleotide sequence that is complementary to a sequence in the target DNA; and (b) a second segment that interacts with a site-directed modifying polypeptide; and (ii) a site-directed modifying polypeptide, or a polynucleotide encoding the same, wherein the site-directed modifying polypeptide comprises: (a) an RNA-binding portion that interacts with the DNA-targeting RNA; and (b) an activity portion that exhibits nuclease activity that creates a double strand break in the target DNA; wherein the site of the double strand break is determined by the DNA-targeting RNA, the contacting occurs under conditions that are permissive for nonhomologous end joining or homology-directed repair, and the target DNA is cleaved and rejoined to produce a modified DNA sequence; thereby producing the genetically modified cell; and (II) transplanting the genetically modified cell into the subject. In some cases, the method further comprises contacting the cell with a donor polynucleotide, wherein the donor polynucleotide, a portion of the donor polynucleotide, a copy of the donor polynucleotide, or a portion of a copy of the donor polynucleotide integrates into the target DNA. In some cases, the method does not comprise contacting the cell with a donor polynucleotide, wherein the target DNA is modified such that nucleotides within the target DNA are deleted. In some cases, the cell is selected from the group consisting of: an archaeal cell, a bacterial cell, a eukaryotic cell, a eukaryotic single-cell organism, a somatic cell, a germ cell, a stem cell, a plant cell, an algal cell, an animal cell, in invertebrate cell, a vertebrate cell, a fish cell, an amphibian cell, a bird cell, a mammalian cell, an ungulate cell, a rodent cell, a non-human primate cell, and a human cell.

Features of the present disclosure include a method of modifying target DNA in a genetically modified cell that comprises a nucleotide sequence encoding an exogenous site-directed modifying polypeptide, the method comprising introducing into the genetically modified cell a DNA-targeting RNA, or a DNA polynucleotide encoding the same, wherein: (i) the DNA-targeting RNA comprises: (a) a first segment comprising a nucleotide sequence that is complementary to a sequence in the target DNA; and (b) a second segment that interacts with a site-directed modifying polypeptide; and (ii) the site-directed modifying polypeptide comprises: (a) an RNA-binding portion that interacts with the DNA-targeting RNA; and (b) an activity portion that exhibits nuclease activity. In some cases, the site-directed modifying polypeptide comprises an amino acid sequence having at least about 75% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346. In some cases, the cell is selected from the group consisting of: an archaeal cell, a bacterial cell, a eukaryotic cell, a eukaryotic single-cell organism, a somatic cell, a germ cell, a stem cell, a plant cell, an algal cell, an animal cell, in invertebrate cell, a vertebrate cell, a fish cell, an amphibian cell, a bird cell, a mammalian cell, an ungulate cell, a rodent cell, a non-human primate cell, and a human cell. In some cases, the cell is in vivo. In some cases, the cell is in vitro. In some cases, the expression of the site-directed modifying polypeptide is under the control of an inducible promoter. In some cases, the expression of the site-directed modifying polypeptide is under the control of a cell type-specific promoter.

Features of the present disclosure include a kit comprising: the DNA-targeting RNA, or a DNA polynucleotide encoding the same; and a reagent for reconstitution and/or dilution. In some cases, the kit further comprises a reagent selected from the group consisting of: a buffer for introducing into cells the DNA-targeting RNA, a wash buffer, a control reagent, a control expression vector or RNA polynucleotide, a reagent for transcribing the DNA-targeting RNA from DNA, and combinations thereof.

Features of the present disclosure include a kit comprising: a site-directed modifying polypeptide of the present disclosure, or a polynucleotide encoding the same; and a reagent for reconstitution and/or dilution. In some cases, the kit further comprises a reagent selected from the group consisting of: a buffer for introducing into cells the site-directed modifying polypeptide, a wash buffer, a control reagent, a control expression vector or RNA polynucleotide, a reagent for in vitro production of the site-directed modifying polypeptide from DNA, and combinations thereof.

Features of the present disclosure include a kit comprising: a site-directed modifying polypeptide of the present disclosure, or a polynucleotide encoding the same; and a reagent for reconstitution and/or dilution. Features of the present disclosure include a kit comprising: a DNA-targeting RNA, or a DNA polynucleotide encoding the same, the DNA-targeting RNA comprising: (a) a first segment comprising a nucleotide sequence that is complementary to a sequence in a target DNA; and (b) a second segment that interacts with a site-directed modifying polypeptide; and (ii) the site-directed modifying polypeptide, or a polynucleotide encoding the same, the site-directed modifying polypeptide comprising: (a) an RNA-binding portion that interacts with the DNA-targeting RNA; and (b) an activity portion that exhibits site-directed enzymatic activity, wherein the site of enzymatic activity is determined by the DNA-targeting RNA.

Features of the present disclosure include a kit comprising: (i) a DNA-targeting RNA, or a DNA polynucleotide encoding the same, comprising: (a) a first segment comprising a nucleotide sequence that is complementary to a sequence in a target DNA; and (b) a second segment that interacts with a site-directed modifying polypeptide; and (ii) the site-directed modifying polypeptide, or a polynucleotide encoding the same, comprising: (a) an RNA-binding portion that interacts with the DNA-targeting RNA; and (b) an activity portion that that modulates transcription within the target DNA, wherein the site of modulated transcription within the target DNA is determined by the DNA-targeting RNA.

Features of the present disclosure include a kit comprising: (i) any of the recombinant expression vectors above; and (ii) a reagent for reconstitution and/or dilution. Features of the present disclosure include a kit comprising: (i) any of the recombinant expression vectors above; and (ii) a recombinant expression vector comprising a nucleotide sequence that encodes a site-directed modifying polypeptide, wherein the site-directed modifying polypeptide comprises: (a) an RNA-binding portion that interacts with the DNA-targeting RNA; and (b) an activity portion that exhibits site-directed enzymatic activity, wherein the site of enzymatic activity is determined by the DNA-targeting RNA. Features of the present disclosure include a kit comprising: (i) any of the recombinant expression vectors above; and (ii) a recombinant expression vector comprising a nucleotide sequence that encodes a site-directed modifying polypeptide, wherein the site-directed modifying polypeptide comprises: (a) an RNA-binding portion that interacts with the DNA-targeting RNA; and (b) an activity portion that modulates transcription within the target DNA, wherein the site of modulated transcription within the target DNA is determined by the DNA-targeting RNA.

Features of the present disclosure include a kit for targeting target DNA comprising: two or more DNA-targeting RNAs, or DNA polynucleotides encoding the same, wherein the first segment of at least one of the two or more DNA-targeting RNAs differs by at least one nucleotide from the first segment of at least one other of the two or more DNA-targeting RNAs.

BRIEF DESCRIPTION OF THE DRAWINGS

FIG. 3A-3B depict the amino acid sequence of a Cas9/Csn1 protein from *Streptococcus pyogenes* (SEQ ID NO:8). Cas9 has domains homologous to both HNH and RuvC endonucleases. (FIG. 3A) Motifs 1-4 are overlined (FIG. 3B) Domains 1 and 2 are overlined.

FIG. 4A-4B depict the percent identity between the Cas9/Csn1 proteins from multiple species. (FIG. 4A) Sequence identity relative to *Streptococcus pyogenes*. For Example, Domain 1 is amino acids 7-166 and Domain 2 is amino acids 731-1003 of Cas9/Csn1 from *Streptococcus pyogenes* as depicted in FIG. 3B. (FIG. 4B) Sequence identity relative to *Neisseria meningitidis*. For example, Domain 1 is amino acids 13-139 and Domain 2 is amino acids 475-750 of Cas9/Csn1 from *Neisseria meningitidis* (SEQ ID NO:79).

FIG. 5 depicts a multiple sequence alignment of motifs 1-4 of Cas9/Csn1 proteins from various diverse species selected from the phylogenetic table in FIG. 32 (see FIG. 32, FIG. 3A, and Table 1) (*Streptococcus pyogenes* (Motifs 1-4: SEQ ID NOs.: 1361-1364), *Legionella pneumophila* (Motifs 1-4: SEQ ID NOs.: 1365-1368), *Gamma proteobacterium* (Motifs 1-4: SEQ ID NOs.: 1369-1372), *Listeria innocua* (Motifs 1-4: SEQ ID NOs.: 1373-1376), *Lactobacillus gasseri* (Motifs 1-4: SEQ ID NOs.: 1377-1380), *Eubacterium rectale* (Motifs 1-4: SEQ ID NOs.: 1381-1384), *Staphylococcus lugdunensis* (Motifs 1-4: SEQ ID NOs.: 1385-1388), *Mycoplasma synoviae* (Motifs 1-4: SEQ ID NOs.: 1389-1392), *Mycoplasma mobile* (Motifs 1-4: SEQ ID NOs.: 1393-1396), *Wolinella succinogenes* (Motifs 1-4: SEQ ID NOs.: 1397-1400), *Flavobacterium columnare* (Motifs 1-4: SEQ ID NOs.: 1401-1404), *Fibrobacter succinogenes* (Motifs 1-4: SEQ ID NOs.: 1405-1408), *Bacteroides fragilis* (Motifs 1-4: SEQ ID NOs.: 1409-1412), *Acidothermus cellulolyticus* (Motifs 1-4: SEQ ID NOs.: 1413-1416), and *Bifidobacterium dentium* (Motifs 1-4: SEQ ID NOs.: 1417-1420).

Figures 6A, 6B:
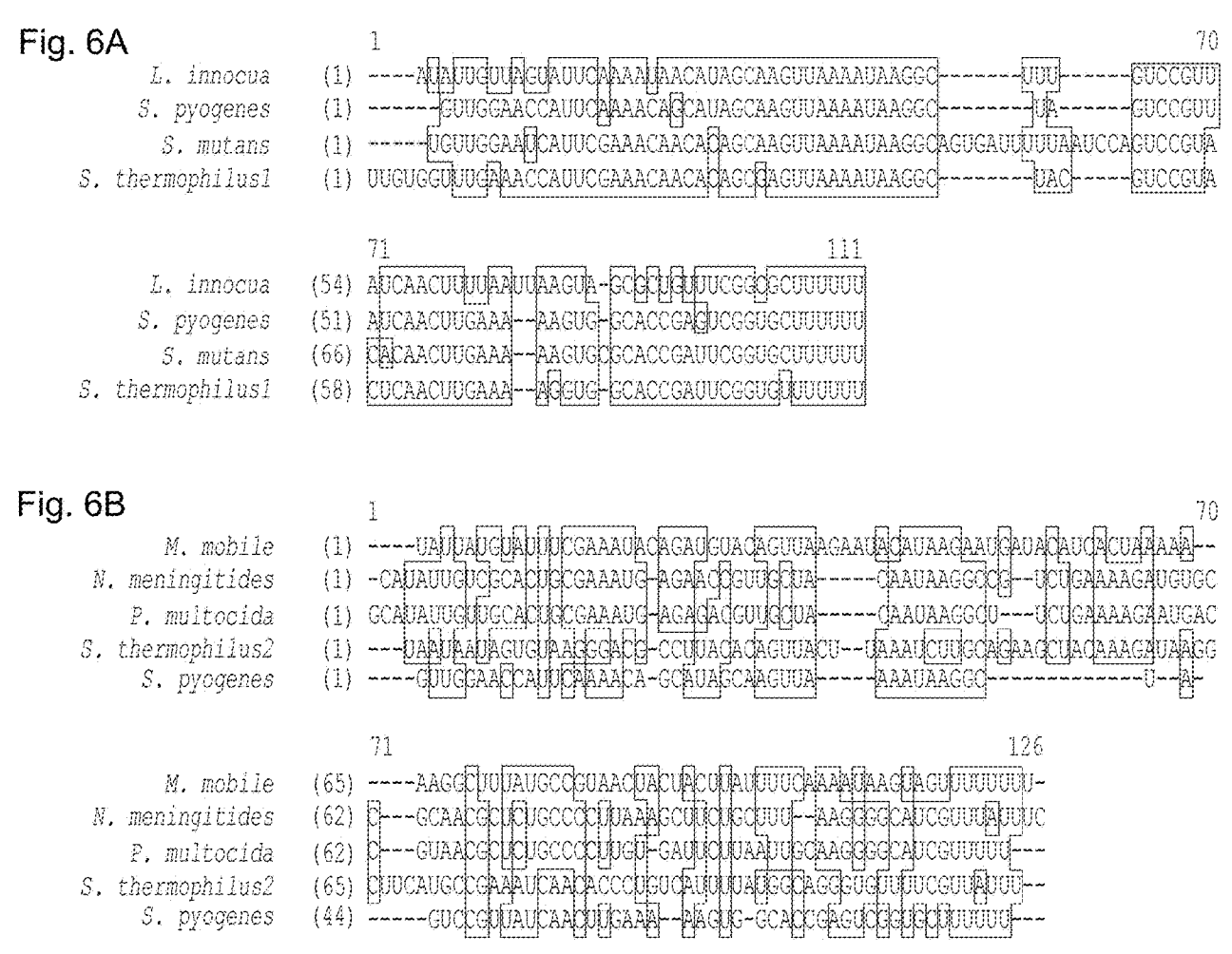

FIG. 6A-6B provide alignments of naturally occurring tracrRNA ("activator-RNA") sequences from various species (*L. innocua* (SEQ ID NO: 434); *S. pyogenes* (SEQ ID NO: 433); *S. mutans* (SEQ ID NO: 435); *S. thermophilus*1 (SEQ ID NO: 436); *M. mobile* (SEQ ID NO: 440); *N. meningitides* (SEQ ID NO: 438); *P. multocida* (SEQ ID NO: 439); *S. thermophilus*2 (SEQ ID NO: 437); and *S. pyogenes* (SEQ ID NO: 433). (FIG. 6A) multiple sequence alignment of selected tracrRNA orthologues (AlignX, VectorNTI package, Invitrogen) associated with CRISPR/Cas loci of similar architecture and highly similar Cas9/Csn1 sequences. Black boxes represent shared nucleotides (FIG. 6B) multiple sequence alignment of selected tracrRNA orthologues (AlignX, VectorNTI package, Invitrogen) associated with CRISPR/Cas loci of different architecture and non-closely related Cas9/Csn1 sequences. Note the sequence similarity of *N. meningitidis* and *P. multocida* tracrRNA orthologues. Black boxes represent shared nucleotides. For more exemplary activator-RNA sequences, see SEQ ID NOs:431-562.

FIG. 7A-7B provide alignments of naturally occurring duplex-forming segments of crRNA ("targeter-RNA") sequences from various species (*L. innocua* (SEQ ID NO:577); *S. pyogenes* (SEQ ID NO:569); *S. mutans* (SEQ ID NO:574); *S. thermophilus*1 (SEQ ID NO:575); *C. jejuni* (SEQ ID NO:597); *S. pyogenes* (SEQ ID NO:569); *F. novicida* (SEQ ID NO:572); *M. mobile* (SEQ ID NO:571); *N. meningitides* (SEQ ID NO:579); *P. multocida* (SEQ ID NO:570); and *S. thermophilus*2 (SEQ ID NO:576). (FIG. 7A) multiple sequence alignments of exemplary duplex-forming segment of targeter-RNA sequences (AlignX, VectorNTI package, Invitrogen) associated with the loci of similar architecture and highly similar Cas9/Csn1 sequences. (FIG. 7B) multiple sequence alignments of exemplary duplex-forming segment of targeter-RNA sequences (AlignX, VectorNTI package, Invitrogen) associated with the loci of different architecture and diverse Cas9 sequences. Black boxes represent shared nucleotides. For more exemplary duplex-forming segments targeter-RNA sequences, see SEQ ID NOs:563-679.

FIG. 8 provides a schematic of hybridization for naturally occurring duplex-forming segments of the crRNA ("targeter-RNA") with the duplex-forming segment of the corresponding tracrRNA orthologue ("activator-RNA"). Upper sequence, targeter-RNA; lower sequence, duplex-forming segment of the corresponding activator-RNA. The CRISPR loci belong to the Type II (Nmeni/CASS4) CRISPR/Cas system. Nomenclature is according to the CRISPR database (CRISPR DB). SEQ ID numbers are listed top to bottom: *S. pyogenes* (SEQ ID NOs:569 and 442); *S. mutans* (SEQ ID NOs:574 and 443); *S. thermophilus*1 (SEQ ID NOs:575 and 444); *S. thermophilus*2 (SEQ ID NOs:576 and 445); *L. innocua* (SEQ ID NOs:577 and 446); *T. denticola* (SEQ ID NOs:578 and 448); *N. meningitides* (SEQ ID NOs:579 and 449); *S. gordonii* (SEQ ID NOs:580 and 451); *B. bifidum* (SEQ ID NOs:581 and 452); *L. salivarius* (SEQ ID NOs:582 and 453); *F. tularensis* (SEQ ID NOs:583, 454, 584, and 455); and *L. pneumophila* (SEQ ID NOs:585 and 456). Note that some species contain each two Type II CRISPR loci. For more exemplary activator-RNA sequences, see SEQ ID NOs:431-562. For more exemplary duplex-forming segments targeter-RNA sequences, see SEQ ID NOs:563-679.

FIG. 9 depicts example tracrRNA (activator-RNA) and crRNA (targeter-RNA) sequences from two species. A degree of interchangeability exists; for example, the *S. pyogenes* Cas9/Csn1 protein is functional with tracrRNA and crRNA derived from *L. innocua*. (|) denotes a canonical Watson-Crick base pair while (•) denotes a G-U wobble base pair. "Variable 20 nt" or "20 nt" represents the DNA-targeting segment that is complementary to a target DNA (this region can be up to about 100 nt in length). Also shown is the design of single-molecule DNA-targeting RNA that incorporates features of the targeter-RNA and the activator-RNA. (Cas9/Csn1 protein sequences from a wide variety of species are depicted in FIG. 3A and FIG. 3B and set forth as SEQ ID NOs:1-256 and 795-1346) *Streptococcus pyogenes*: top to bottom: (SEQ ID NO: 1421, 478, 1423); *Listeria innocua*: top to bottom: (SEQ ID NO: 1422, 479, 1424). The sequences provided are non-limiting examples and are meant to illustrate how single-molecule DNA-targeting RNAs and two-molecule DNA-targeting RNAs can be designed based on naturally existing sequences from a wide variety of species. Various examples of suitable sequences from a wide variety of species are set forth as follows (Cas9 protein: SEQ ID NOs:1-259; tracrRNAs: SEQ ID NOs:431-562, or the complements thereof; crRNAs: SEQ ID NOs:

563-679, or the complements thereof; and example single-molecule DNA-targeting RNAs: SEQ ID NOs:680-682).

FIG. 10A-10E show that Cas9 is a DNA endonuclease guided by two RNA molecules. FIG. 10 E (top to bottom, SEQ ID NOs: 278-280, and 431).

Figure 11A:
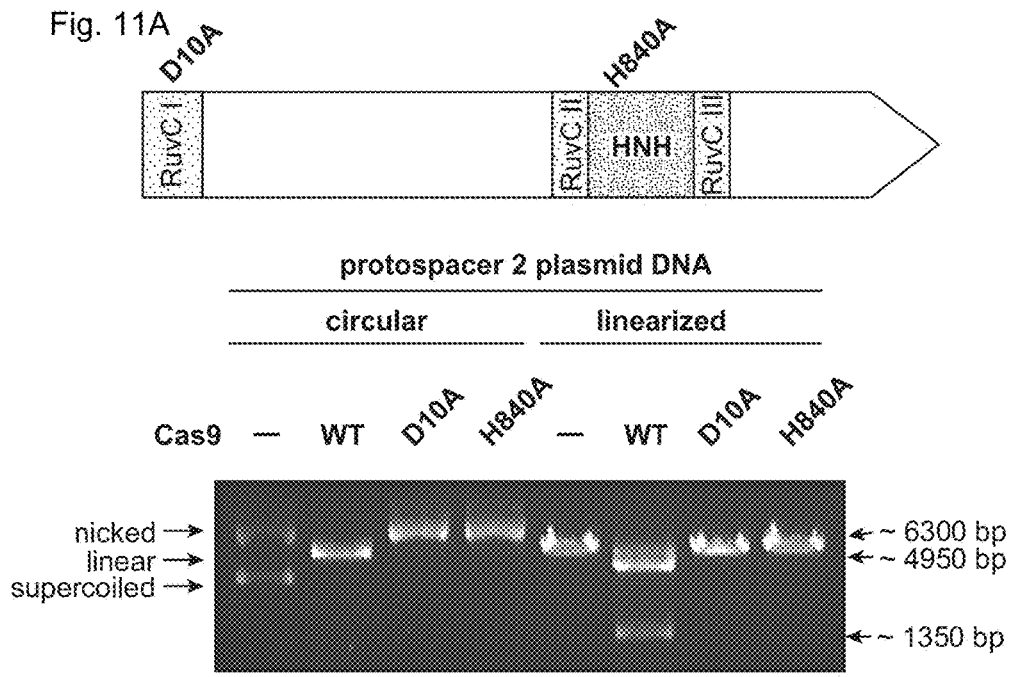
Figure 11B:
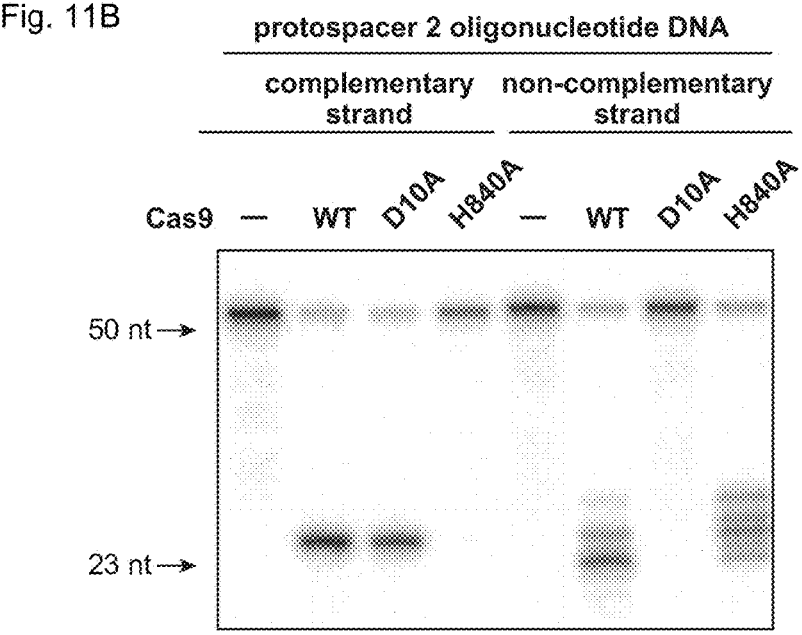

FIG. 11A-11B demonstrate that Cas9 uses two nuclease domains to cleave the two strands in the target DNA.

Figure 12C:
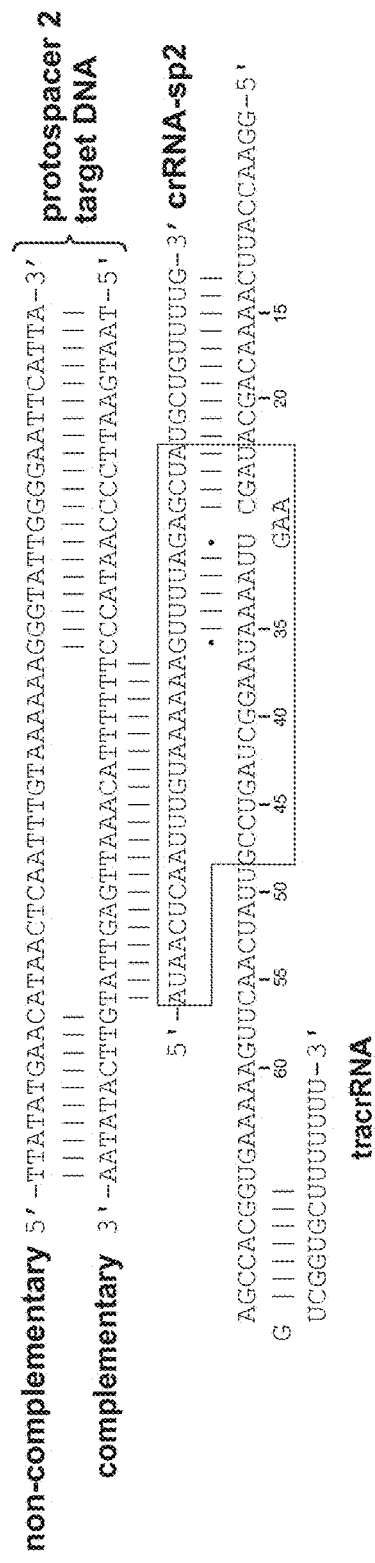
Figure 12D:
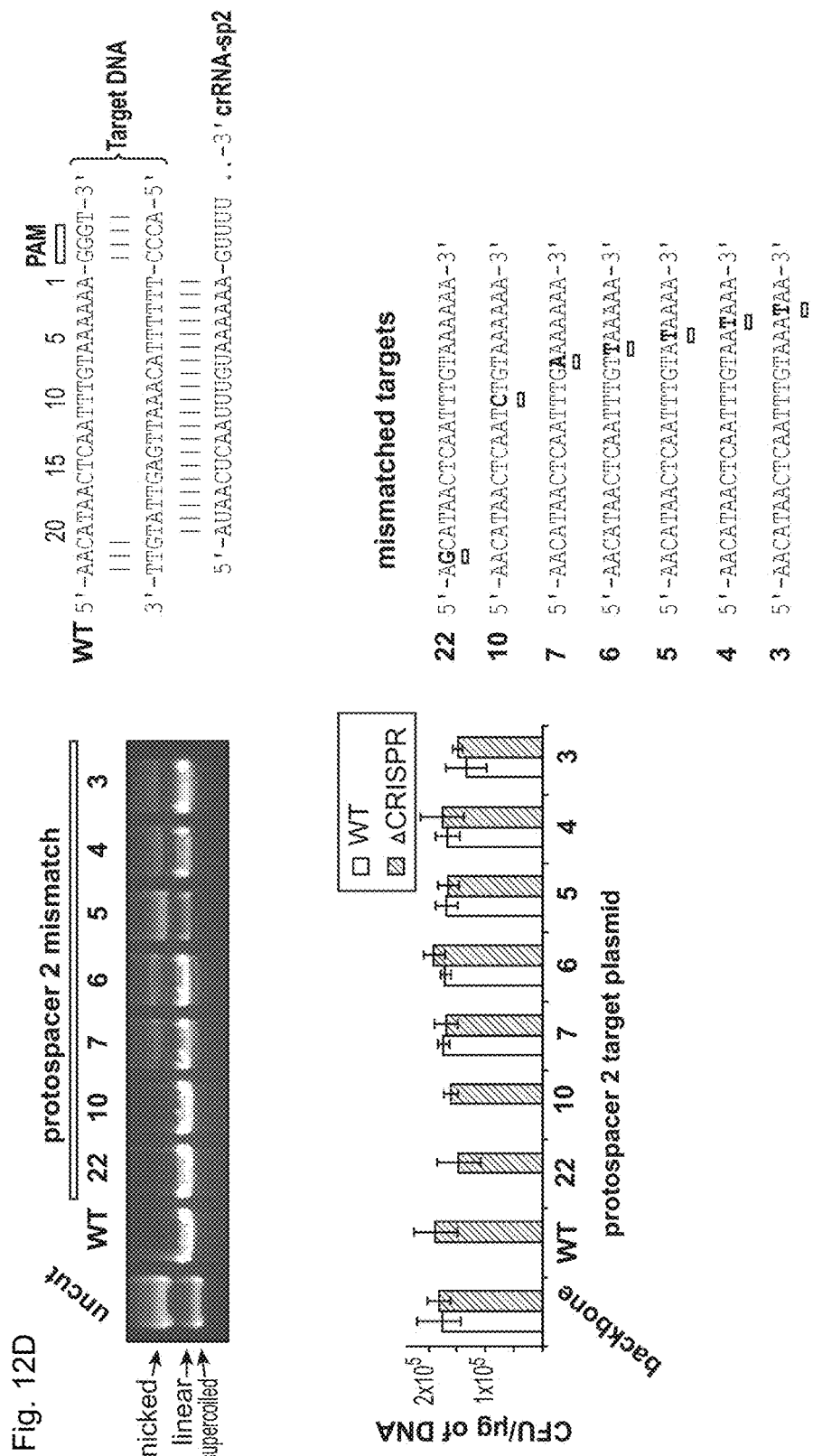

FIG. 12A-12E illustrate that Cas9-catalyzed cleavage of target DNA requires an activating domain in tracrRNA and is governed by a seed sequence in the crRNA. FIG. 12C (top to bottom, SEQ ID NO:278-280, and 431); FIG. 12D (top to bottom, SEQ ID NOs: 281-290); and FIG. 12E (top to bottom, SEQ ID NOs: 291-292, 283, 293-298).

Figure 13A:
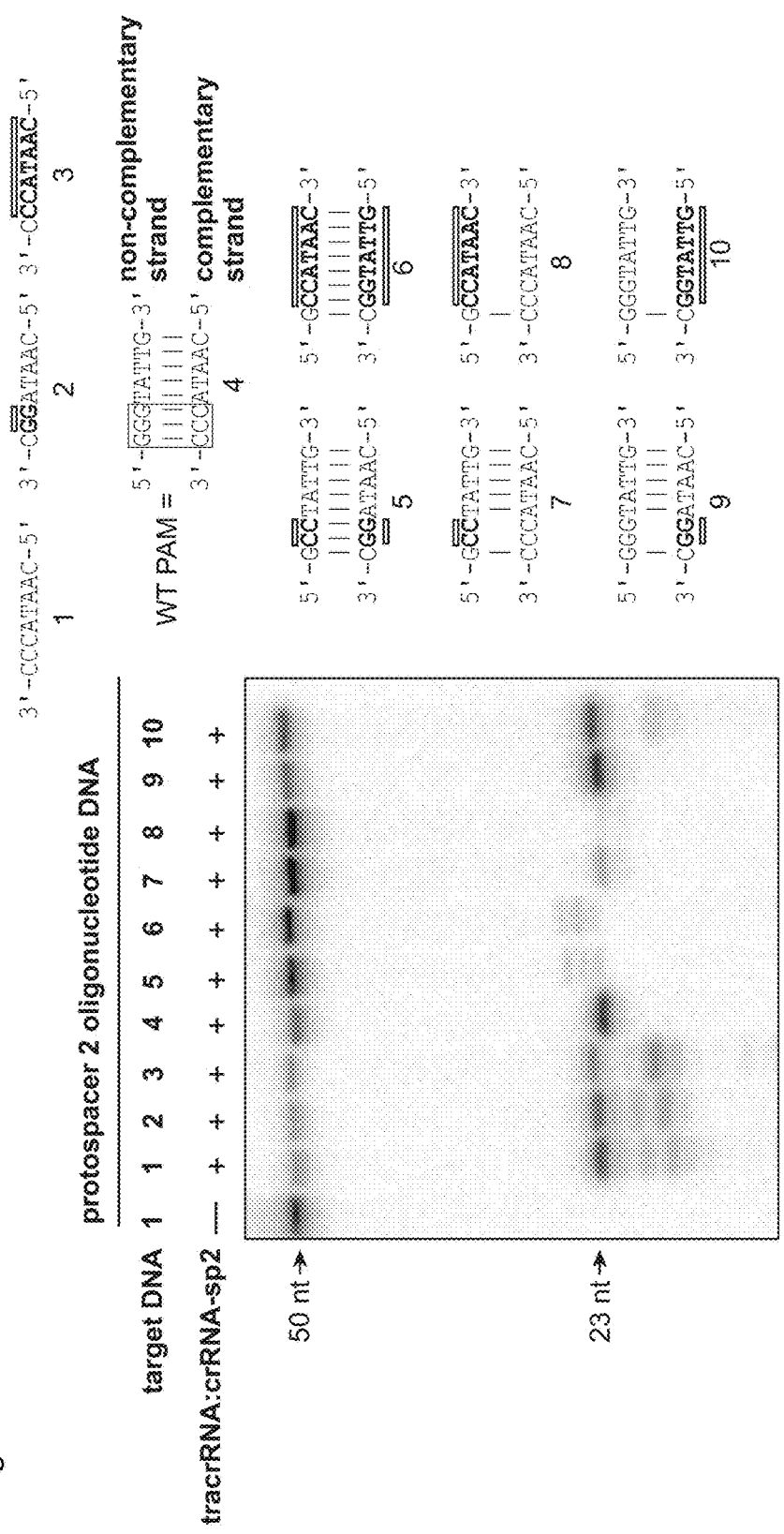
Figure 13B:
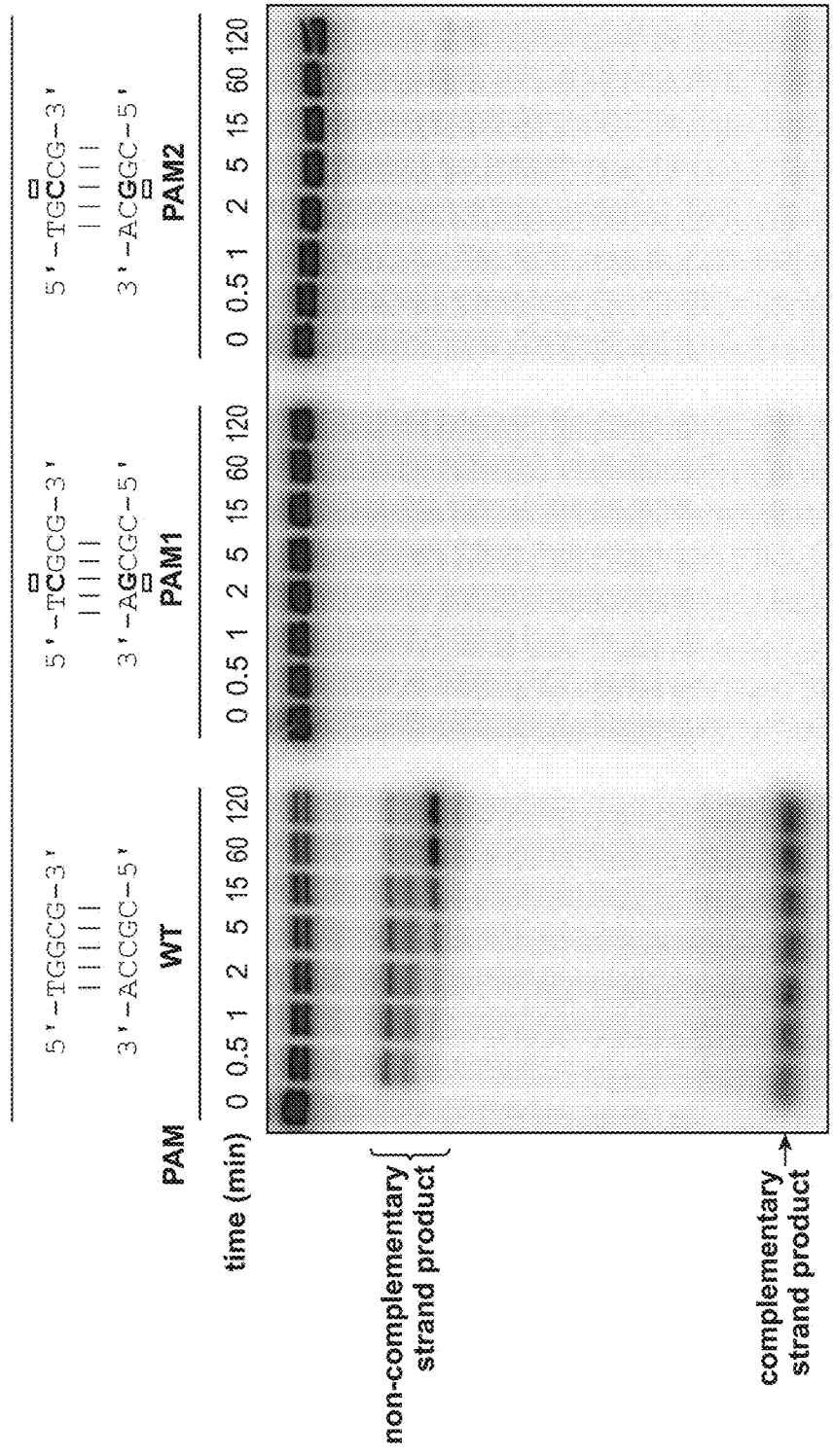
Figure 13C:
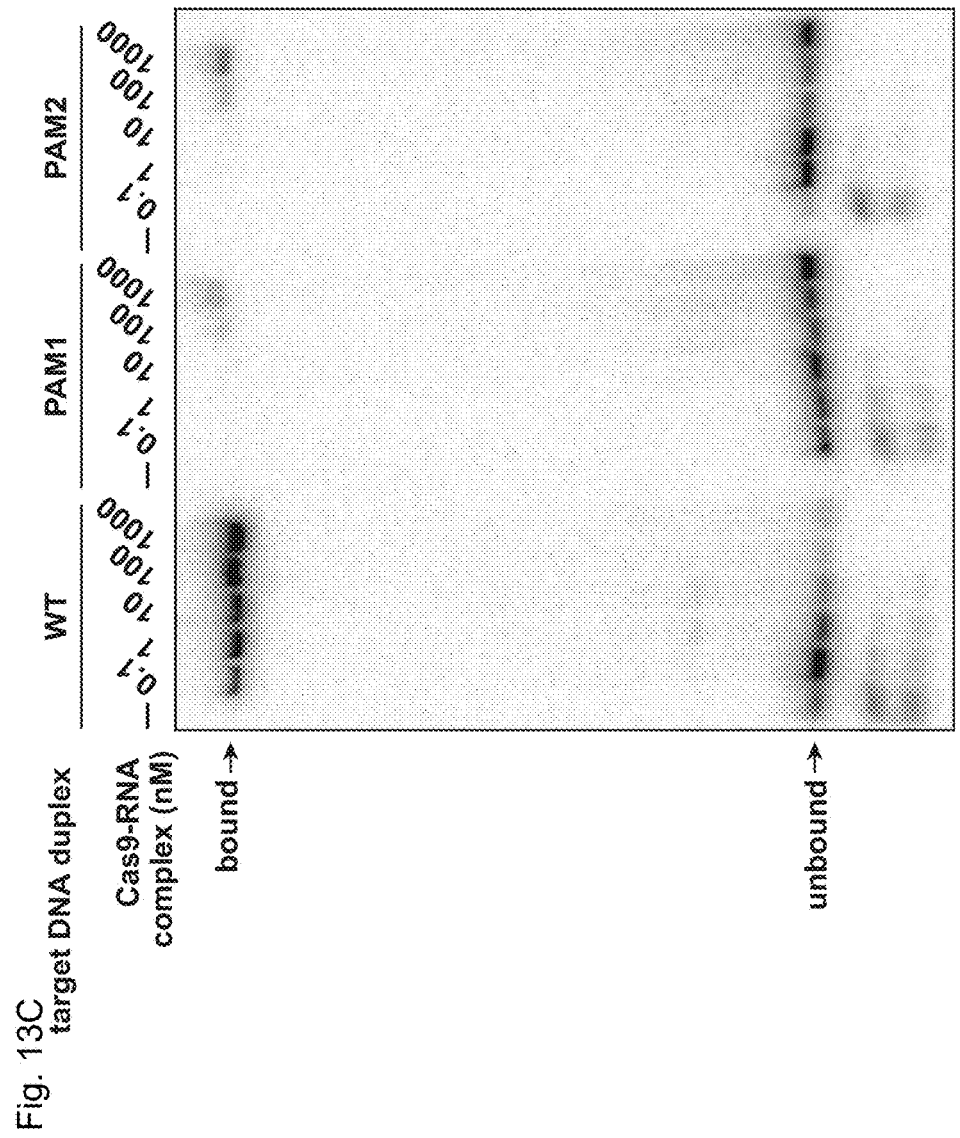

FIG. 13A-13C show that a PAM is required to license target DNA cleavage by the Cas9-tracrRNA:crRNA complex.

Figure 14B:
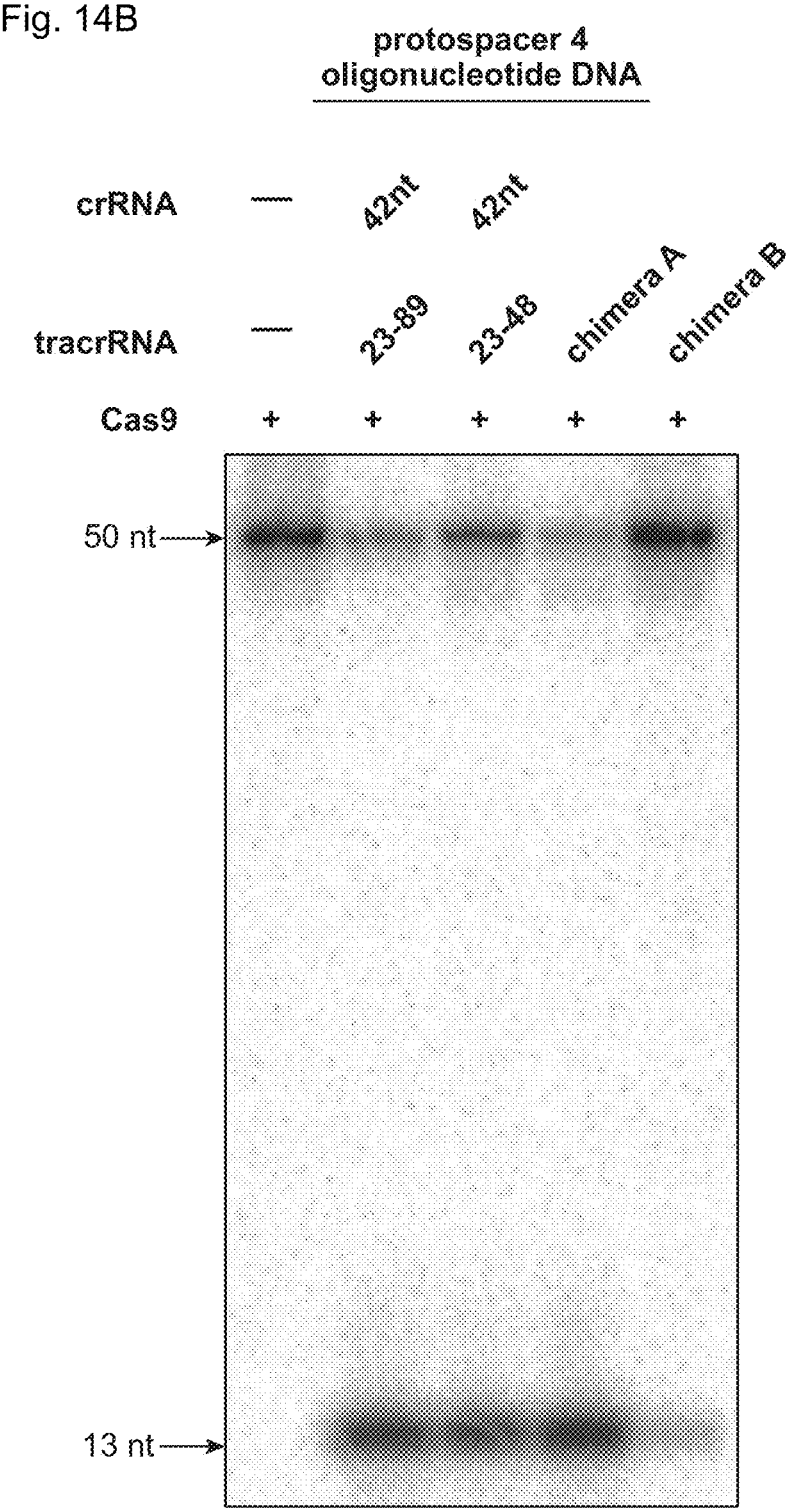
Figure 14C:
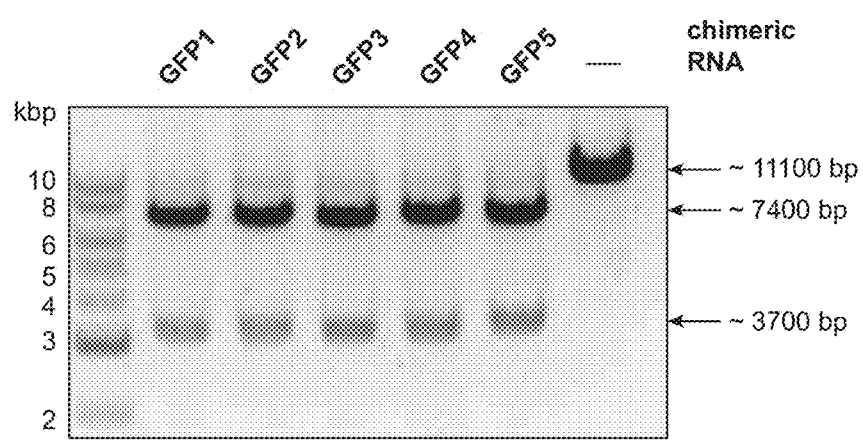

FIG. 14A-14C illustrate that Cas9 can be programmed using a single engineered RNA molecule combining tracrRNA and crRNA features. Chimera A (SEQ ID NO:299); Chimera B (SEQ ID NO:300).

Figure 15:
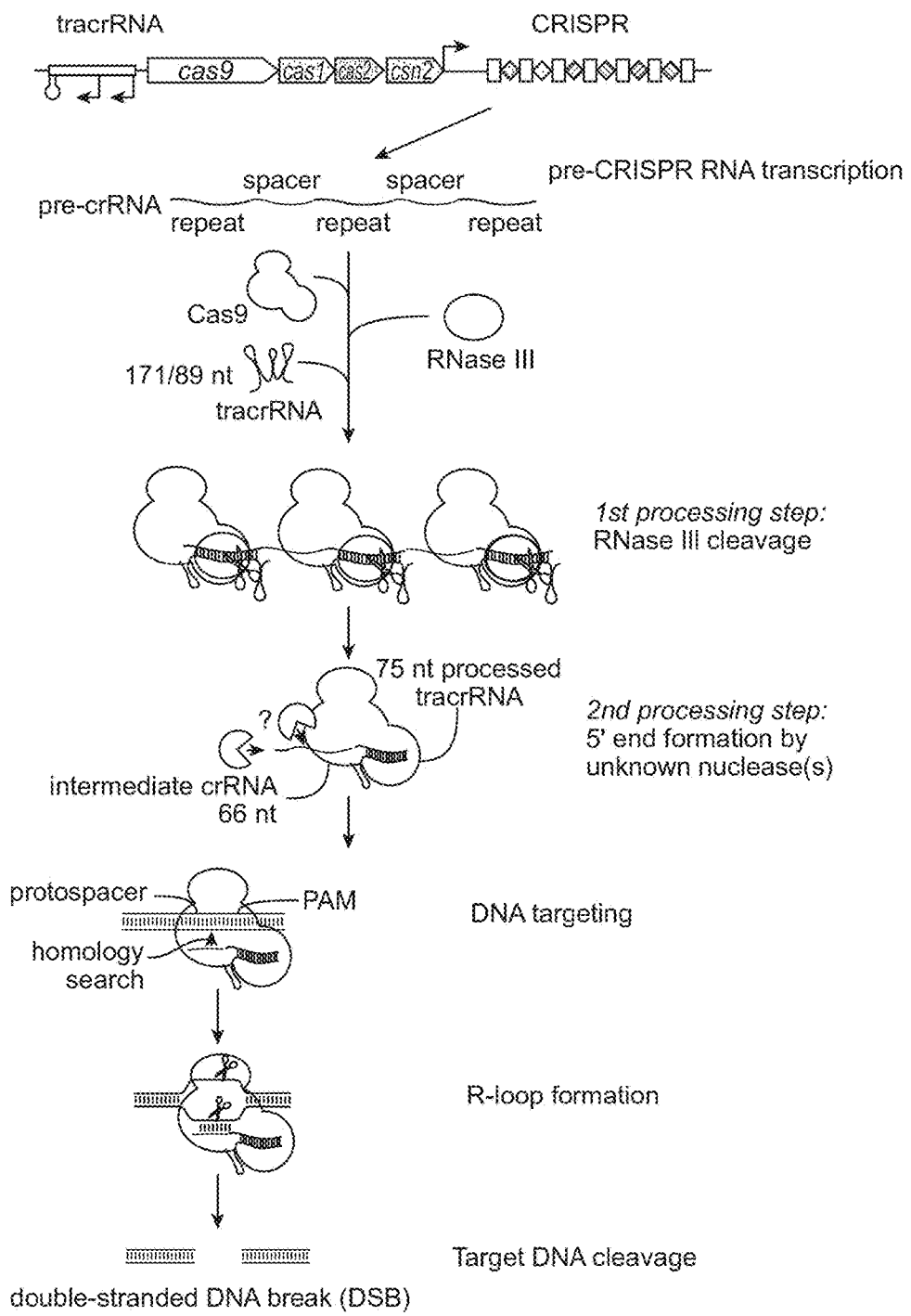

FIG. 15 depicts the type II RNA-mediated CRISPR/Cas immune pathway.

Figures 16A, 16B:
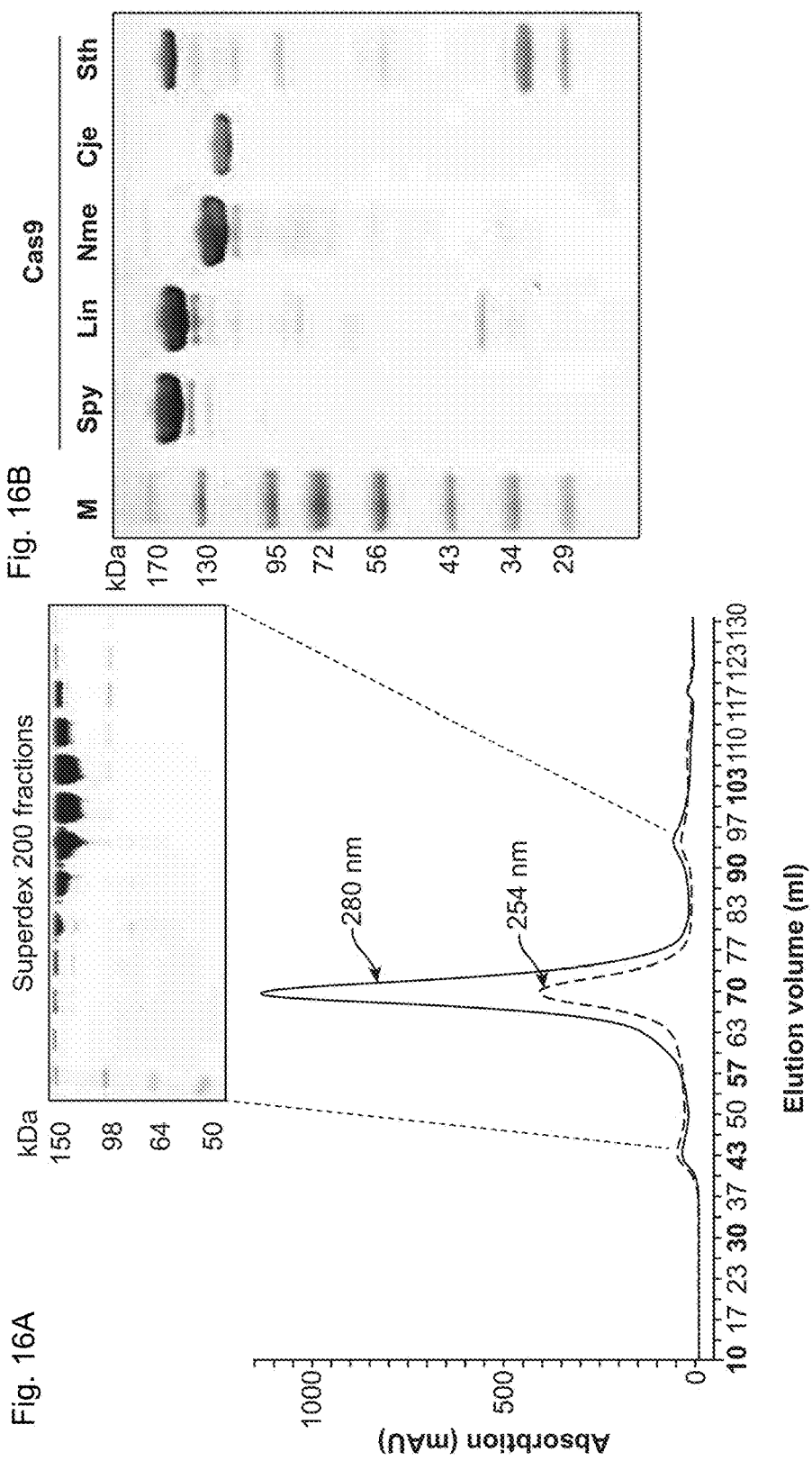

FIG. 16A-16B depict purification of Cas9 nucleases.

Figure 17A:
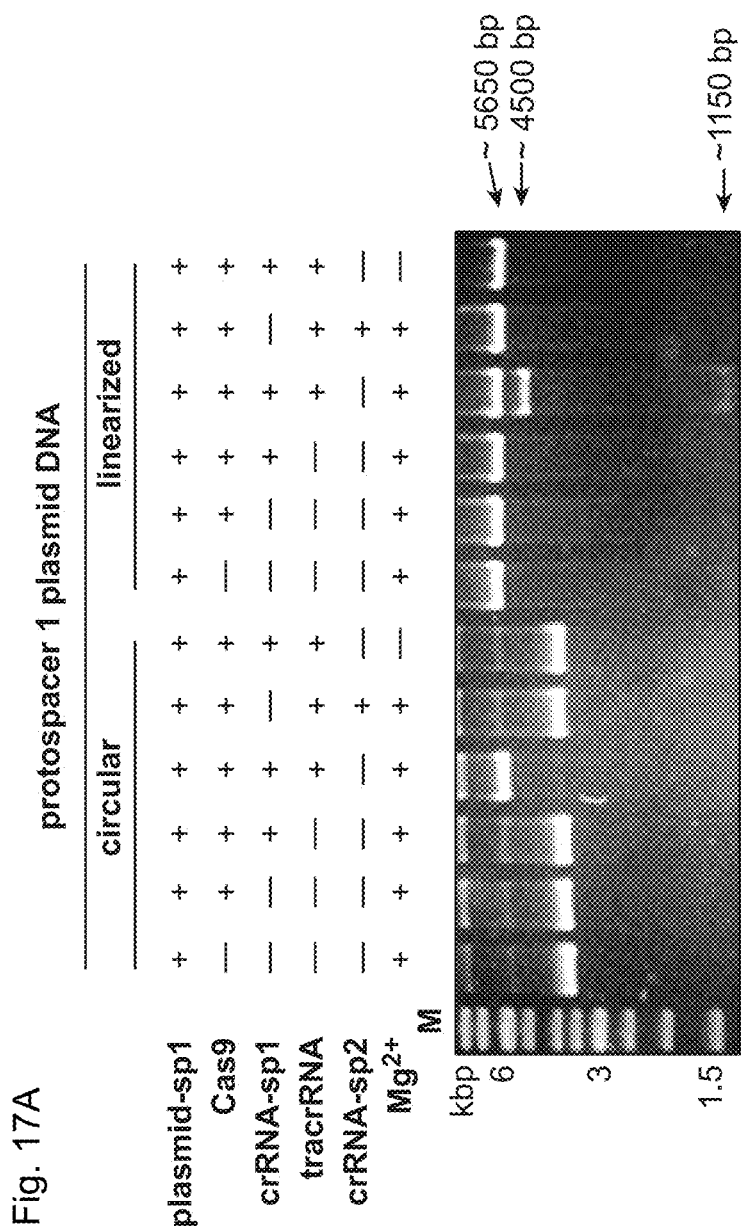
Figure 17B:
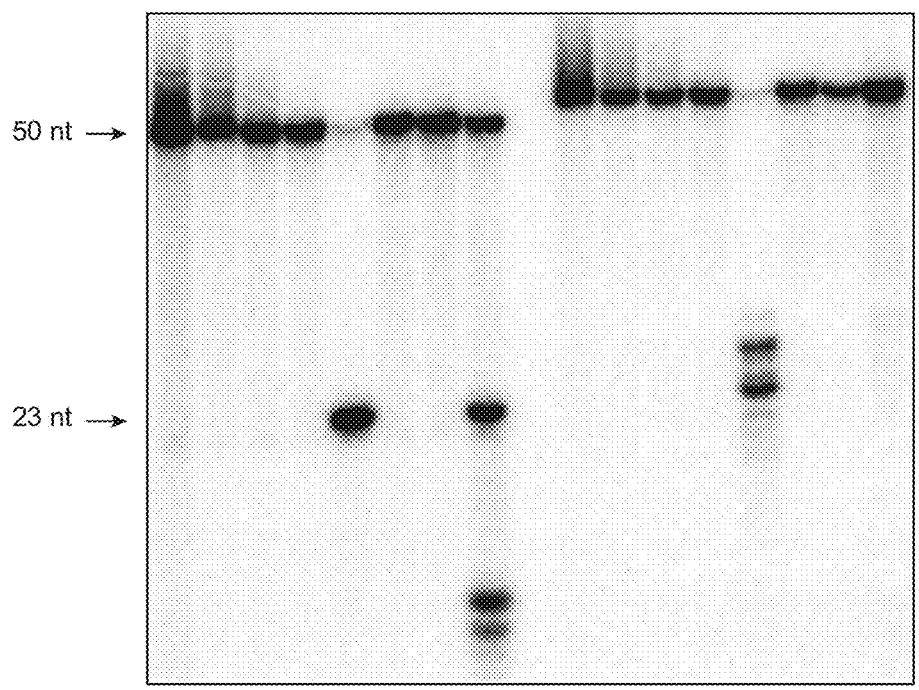

FIG. 17A-17C show that Cas9 guided by dual-tracrRNA:crRNA cleaves protospacer plasmid and oligonucleotide DNA. FIG. 17B (top to bottom, SEQ ID NOs: 301-303, and 487); and FIG. 17C (top to bottom, SEQ ID NO:304-306, and 431).

Figure 18A:
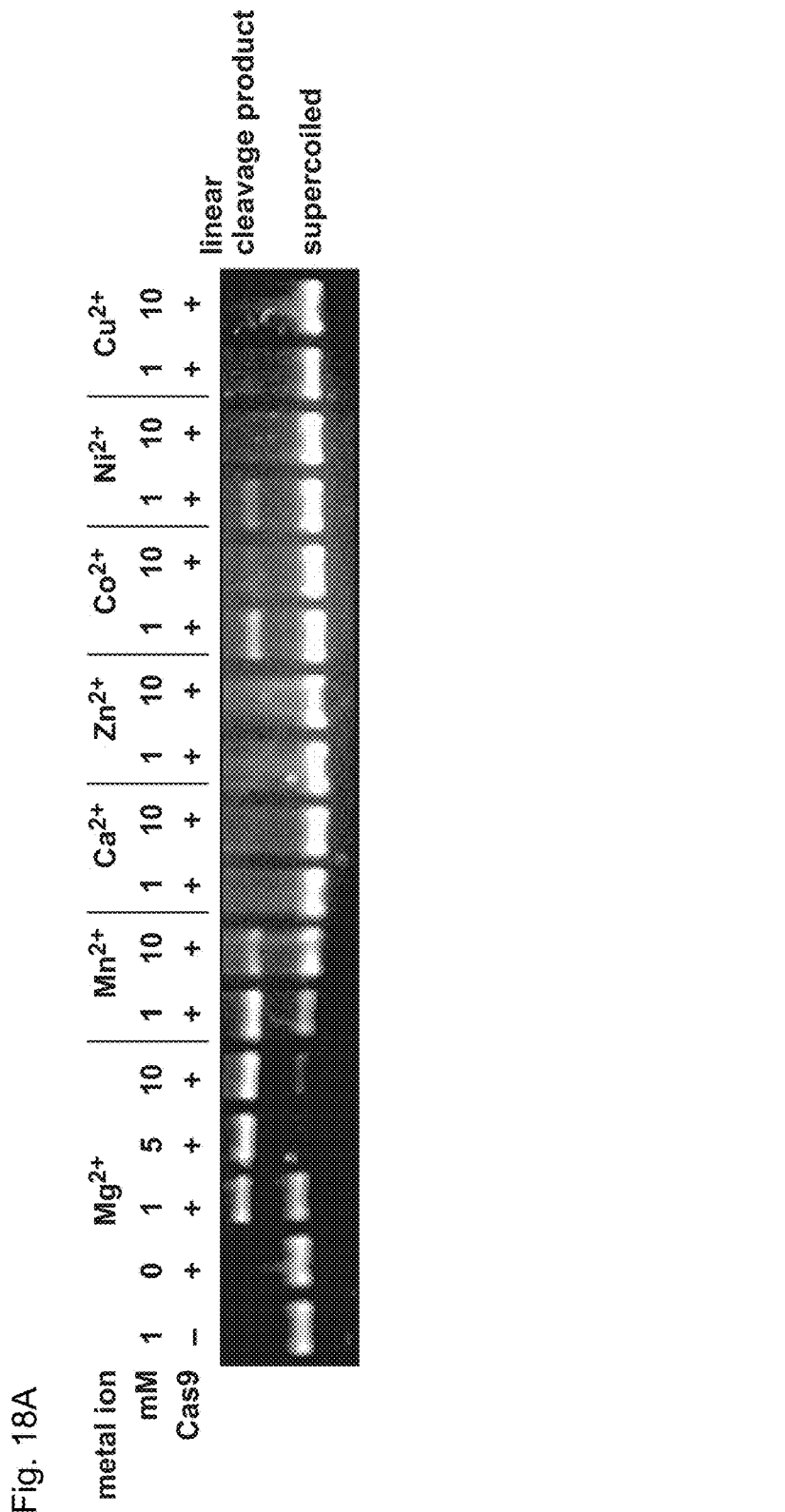
Figure 18B:
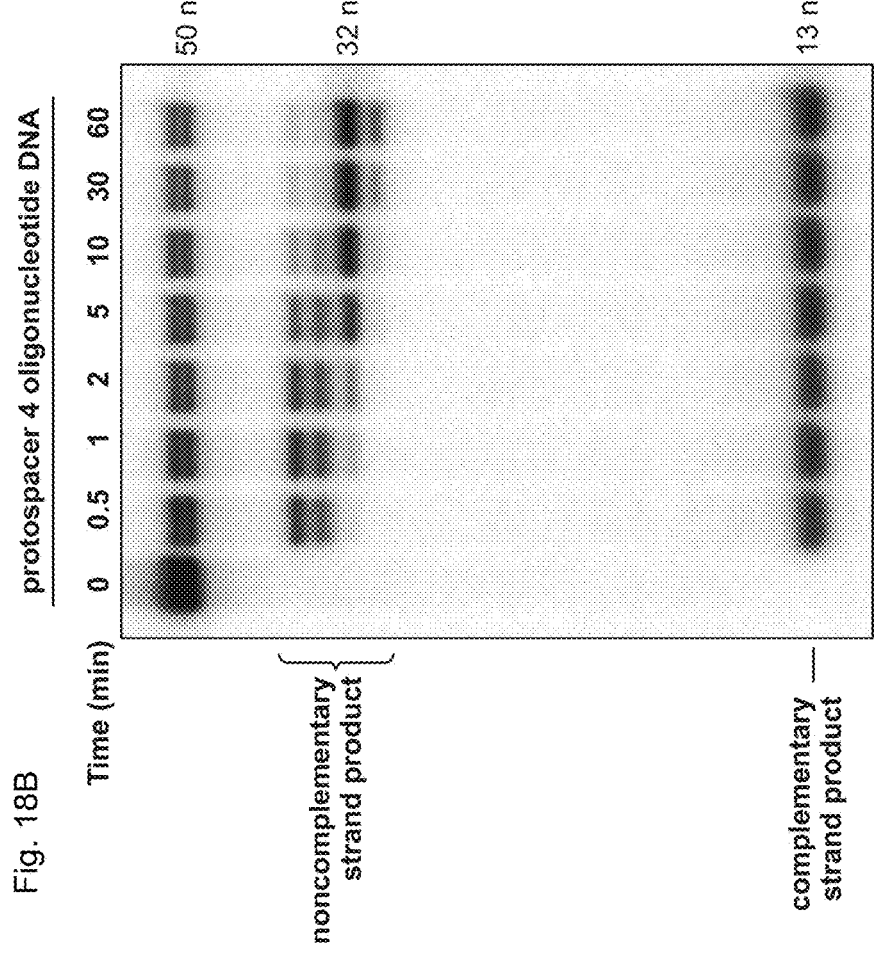

FIG. 18A-18B show that Cas9 is a Mg2+-dependent endonuclease with 3'-5' exonuclease activity.

FIG. 19A-19C illustrate that dual-tracrRNA:crRNA directed Cas9 cleavage of target DNA is site specific. FIG. 19A (top to bottom, SEQ IS NOs: 1350 and 1351) FIG. 19C (top to bottom, SEQ ID NOs: 307-309, 487, 337-339, and 431).

FIG. 20A-20B show that dual-tracrRNA:crRNA directed Cas9 cleavage of target DNA is fast and efficient.

Figure 21A:
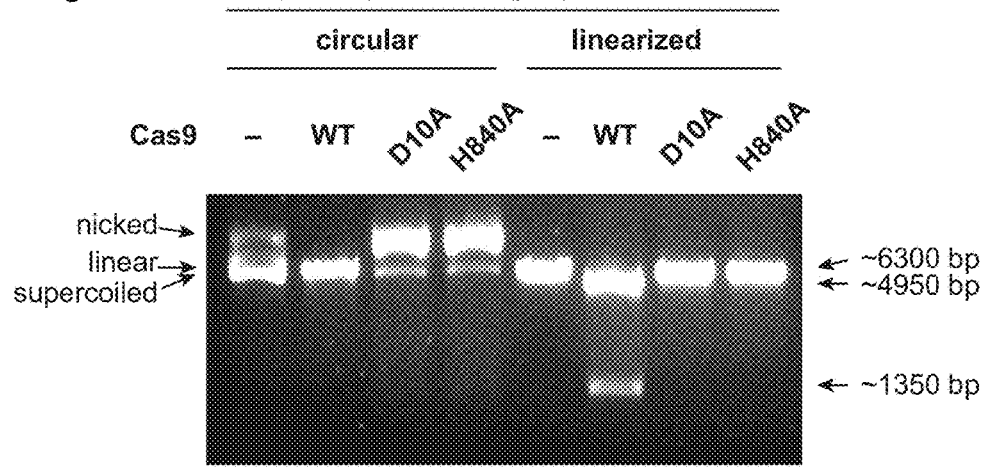
Figure 21B:
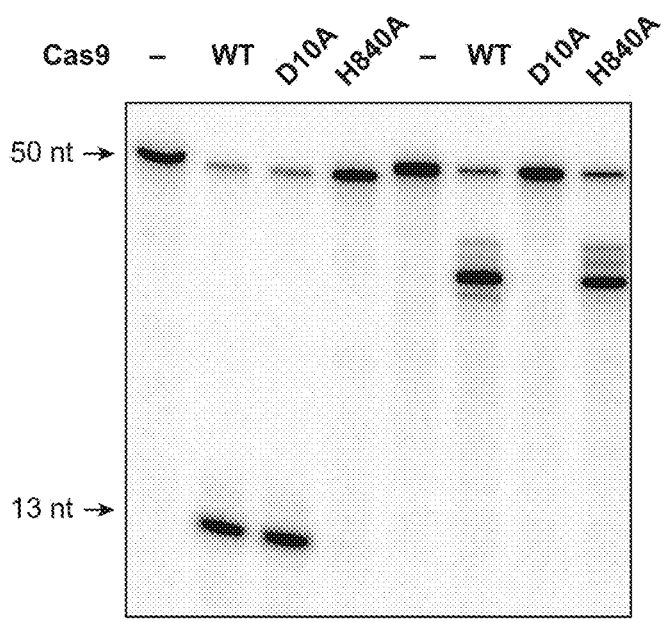

FIG. 21A-21B show that the HNH and RuvC-like domains of Cas9 direct cleavage of the complementary and noncomplementary DNA strand, respectively.

Figure 22:
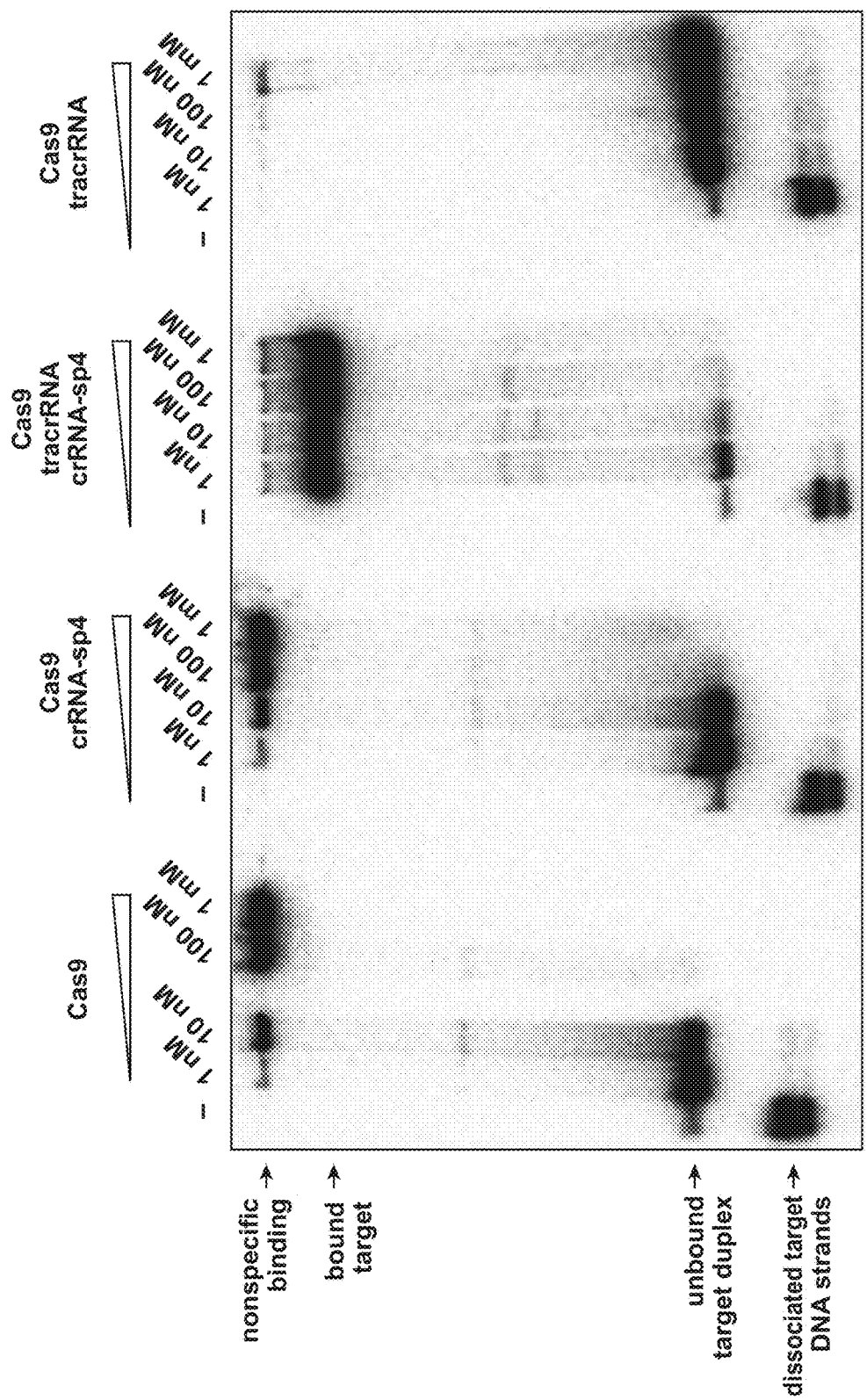

FIG. 22 demonstrates that tracrRNA is required for target DNA recognition.

Figure 23A:
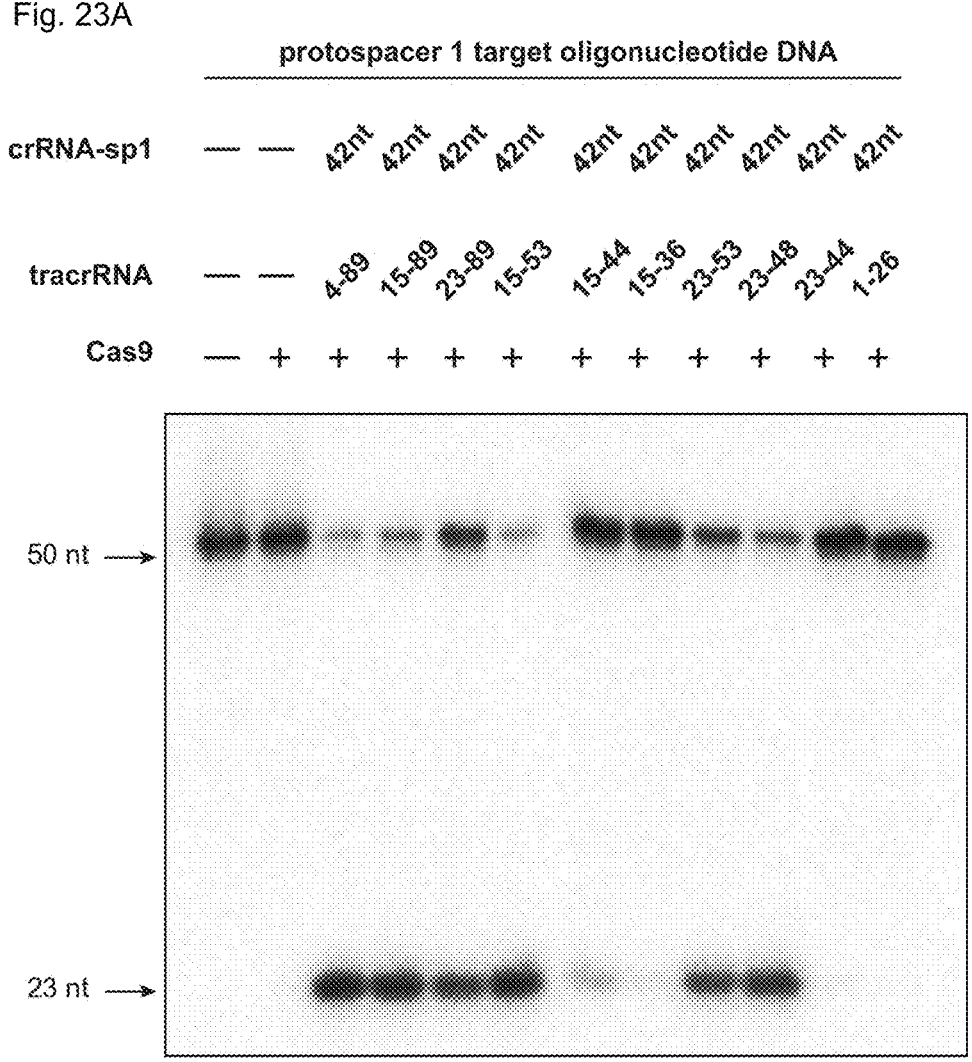
Figure 24A:
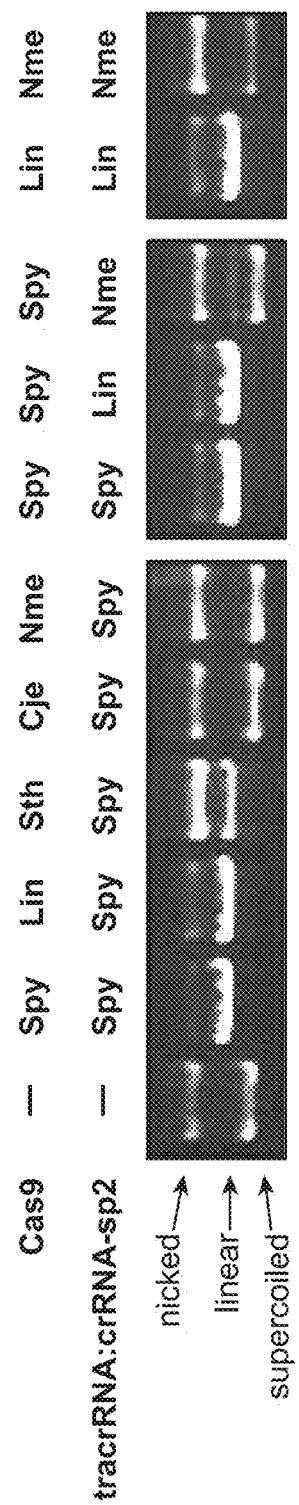
Figure 24B:
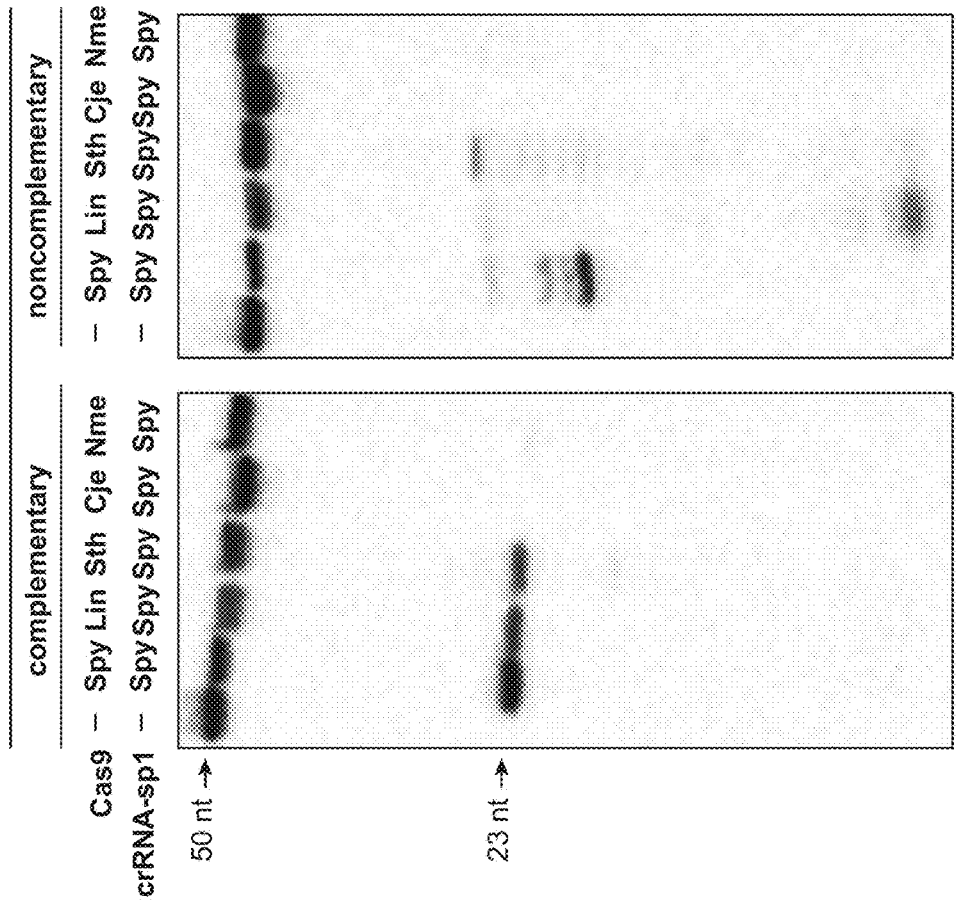

FIG. 23A-23B show that a minimal region of tracrRNA is capable of guiding dualtracrRNA: crRNA directed cleavage of target DNA.

FIG. 24A-24D demonstrate that dual-tracrRNA:crRNA guided target DNA cleavage by Cas9 can be species specific.

Figure 25C:
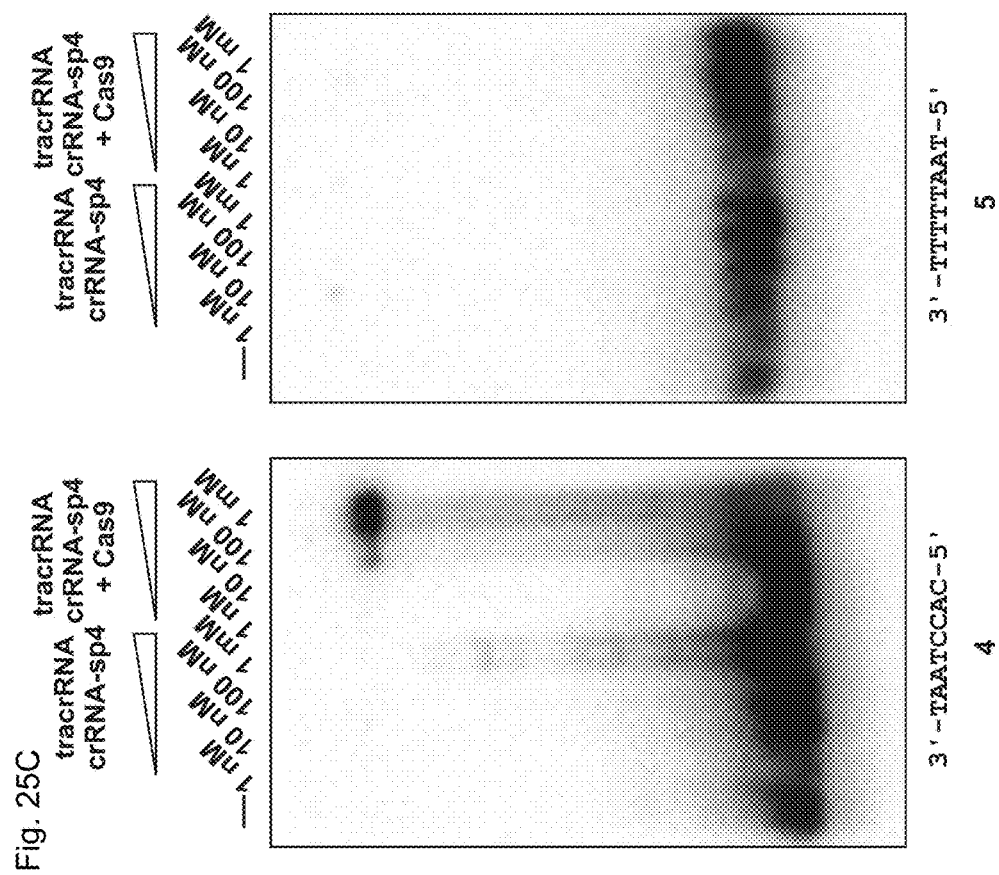

FIG. 25A-25C show that a seed sequence in the crRNA governs dual tracrRNA:crRNA directed cleavage of target DNA by Cas9. FIG. 25A: target DNA probe 1 (SEQ ID NO:310); spacer 4 crRNA (1-42) (SEQ ID NO:311); tracrRNA (15-89) (SEQ ID NO: 1352). FIG. 25B left panel (SEQ ID NO:310).

Figure 26A:
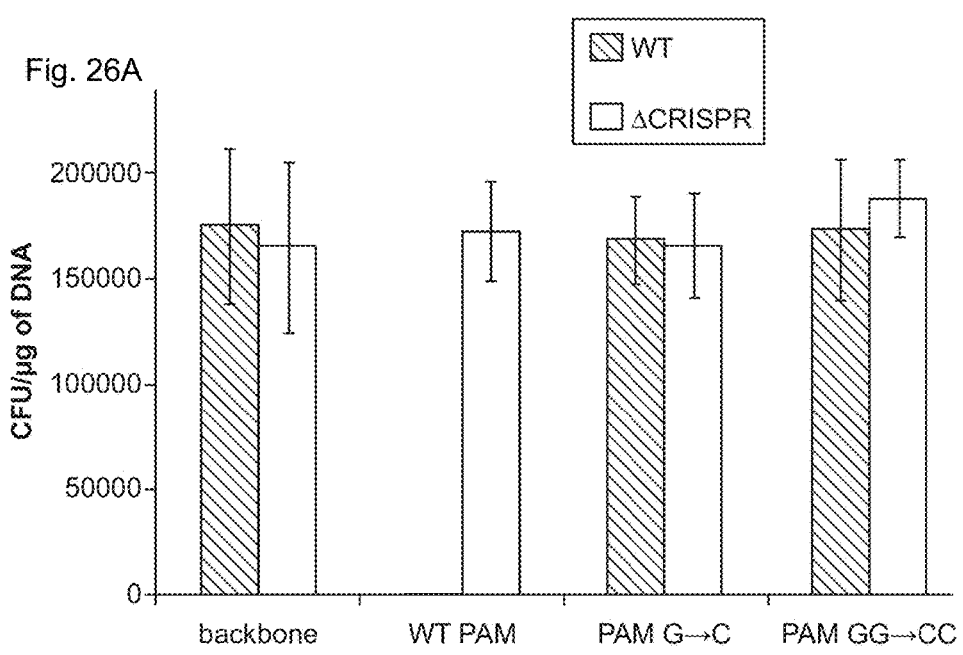
Figure 26B:
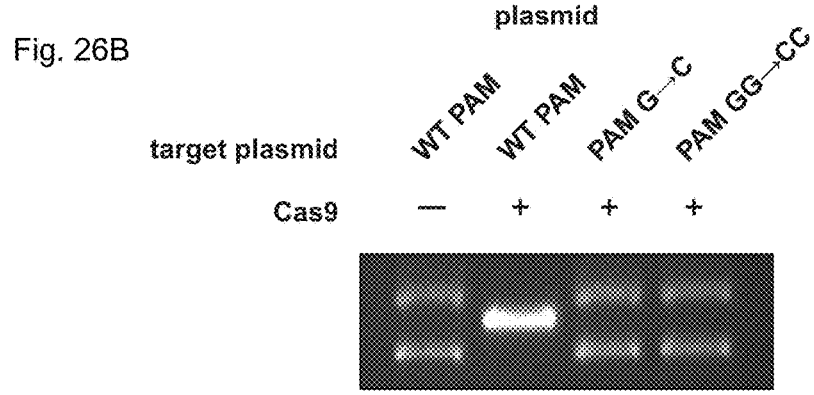
Figure 26C:
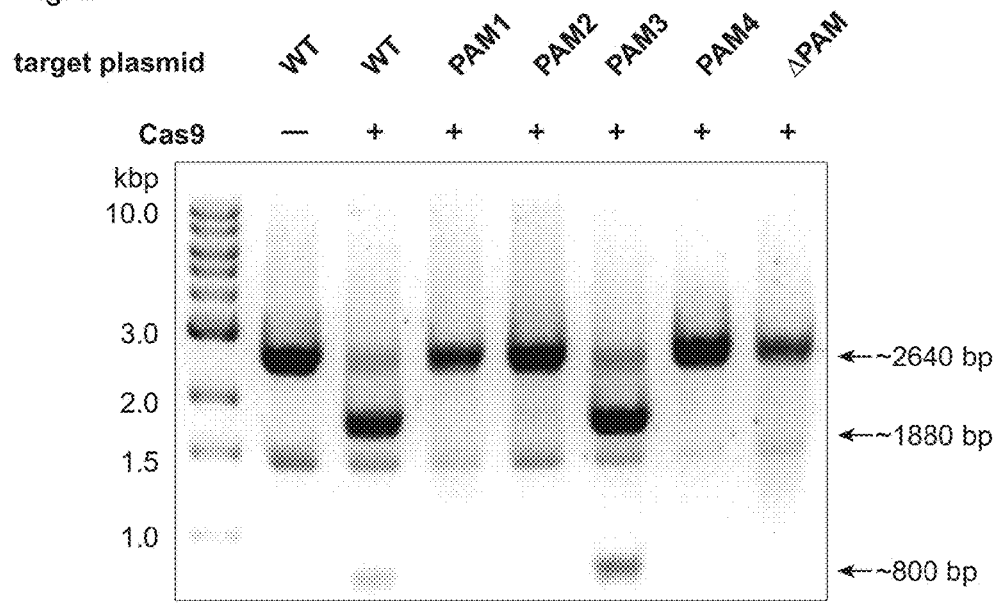

FIG. 26A-26C demonstrate that the PAM sequence is essential for protospacer plasmid DNA cleavage by Cas9-tracrRNA:crRNA and for Cas9-mediated plasmid DNA interference in bacterial cells. FIG. 26B (top to bottom, SEQ ID NOs:312-314); and FIG. 26C (top to bottom, SEQ ID NO:315-320).

FIG. 27A-27C show that Cas9 guided by a single chimeric RNA mimicking dual tracrRNA:crRNA cleaves protospacer DNA. FIG. 27C (top to bottom, SEQ ID NO:321-324).

Figure 28D:
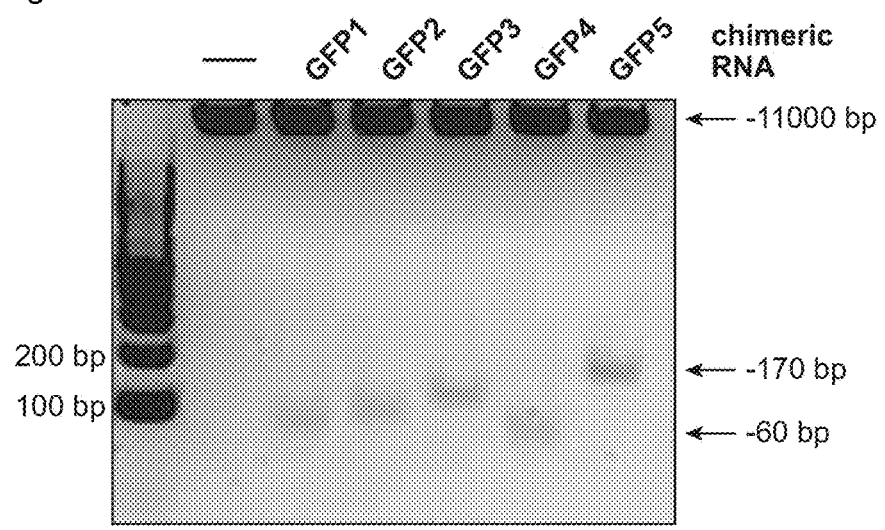

FIG. 28A-28D depict de novo design of chimeric RNAs targeting the Green Fluorescent Protein (GFP) gene sequence. FIG. 28B (top to bottom, SEQ ID NOs:325-326). FIG. 28C: GFP1 target sequence (SEQ ID NO:327); GFP2 target sequence (SEQ ID NO:328); GFP3 target sequence (SEQ ID NO:329); GFP4 target sequence (SEQ ID NO:330); GFP5 target sequence (SEQ ID NO:331); GFP1 chimeric RNA (SEQ ID NO:332); GFP2 chimeric RNA (SEQ ID NO:333); GFP3 chimeric RNA (SEQ ID NO:334); GFP4 chimeric RNA (SEQ ID NO:335); GFP5 chimeric RNA (SEQ ID NO:336).

Figure 29A:
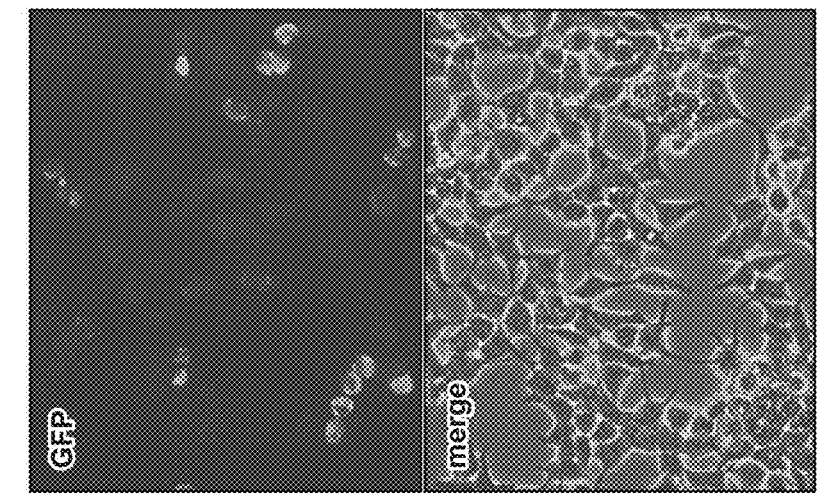

FIG. 29A-29E demonstrate that co-expression of Cas9 and guide RNA in human cells generates double-strand DNA breaks at the target locus. FIG. 29C (top to bottom, SEQ ID NO:425-428).

Figure 30A:
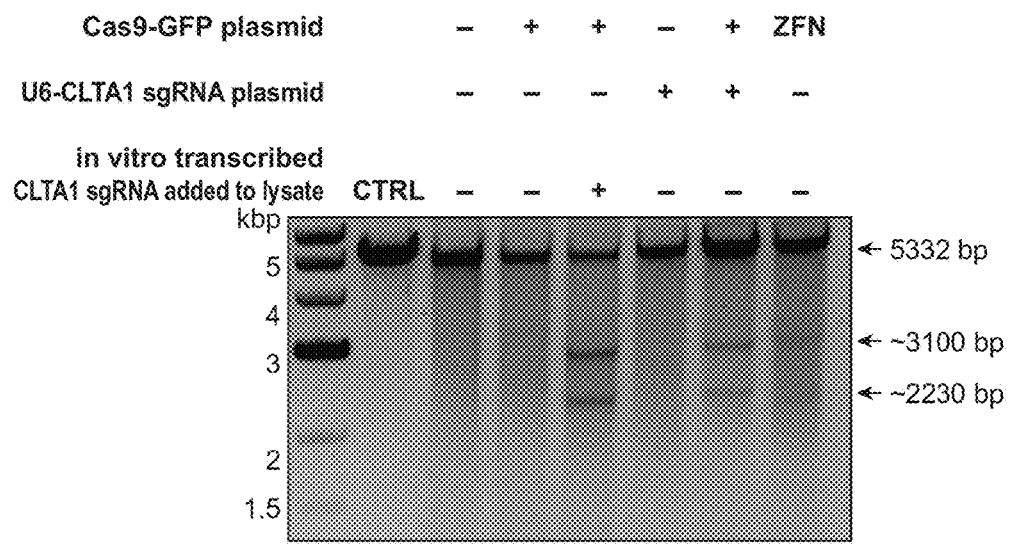
Figure 30B:
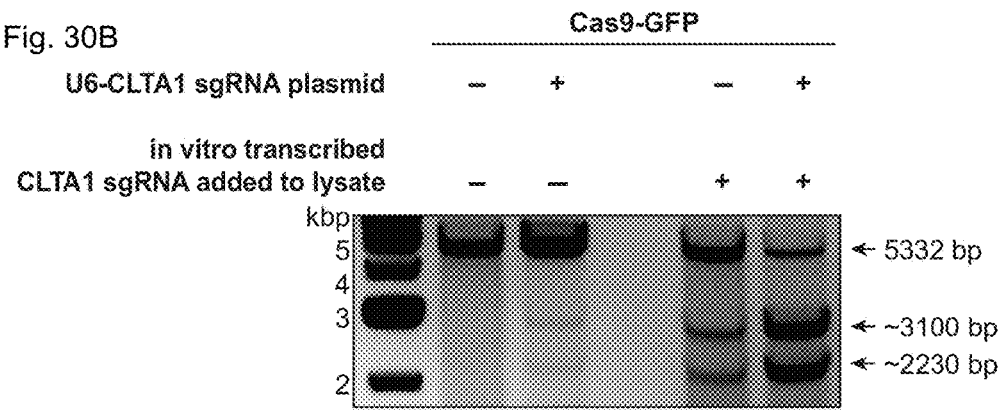

FIG. 30A-30B demonstrate that cell lysates contain active Cas9:sgRNA and support site-specific DNA cleavage.

Figure 31A:
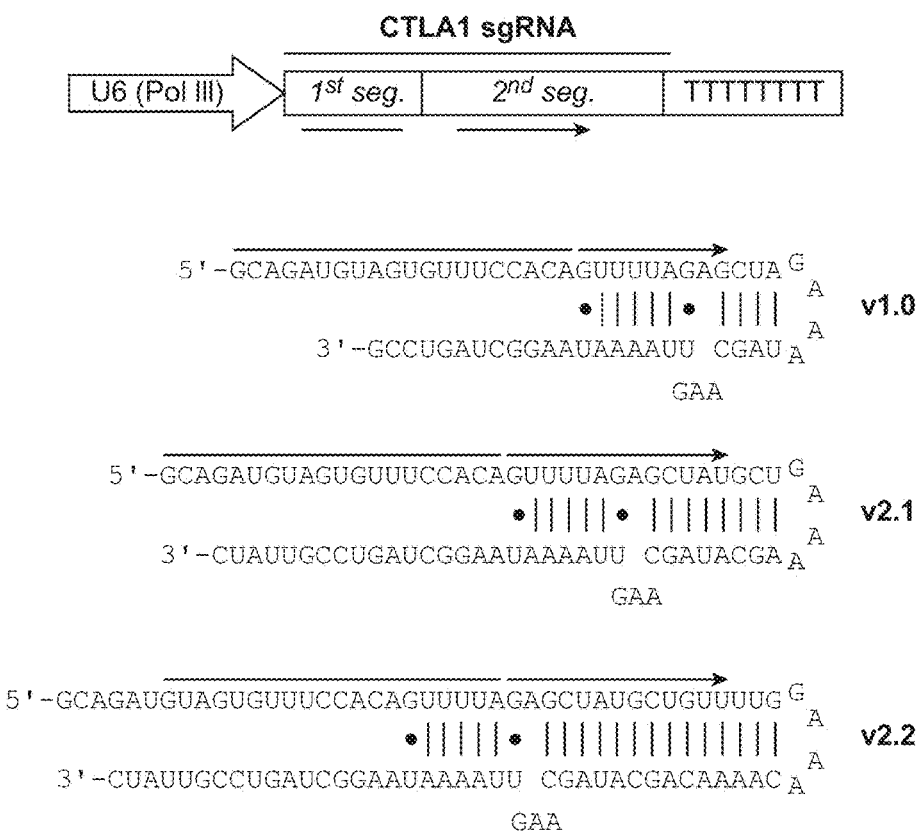
Figure 31B:
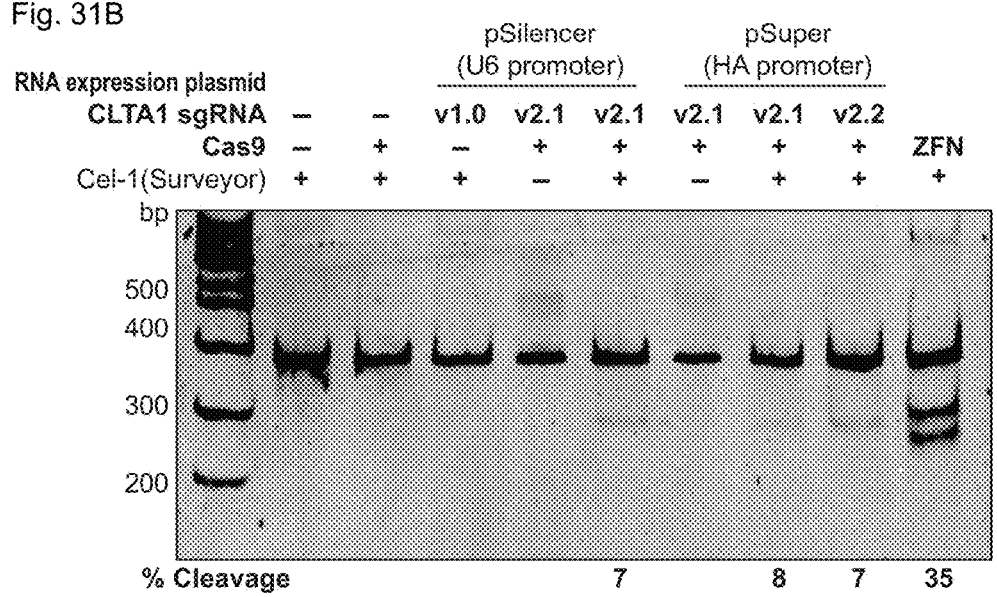

FIG. 31A-31B demonstrate that 3' extension of sgRNA constructs enhances site-specific NHEJ-mediated mutagenesis. FIG. 31A (top to bottom, SEQ ID NO:428-430).

Figure 32A:
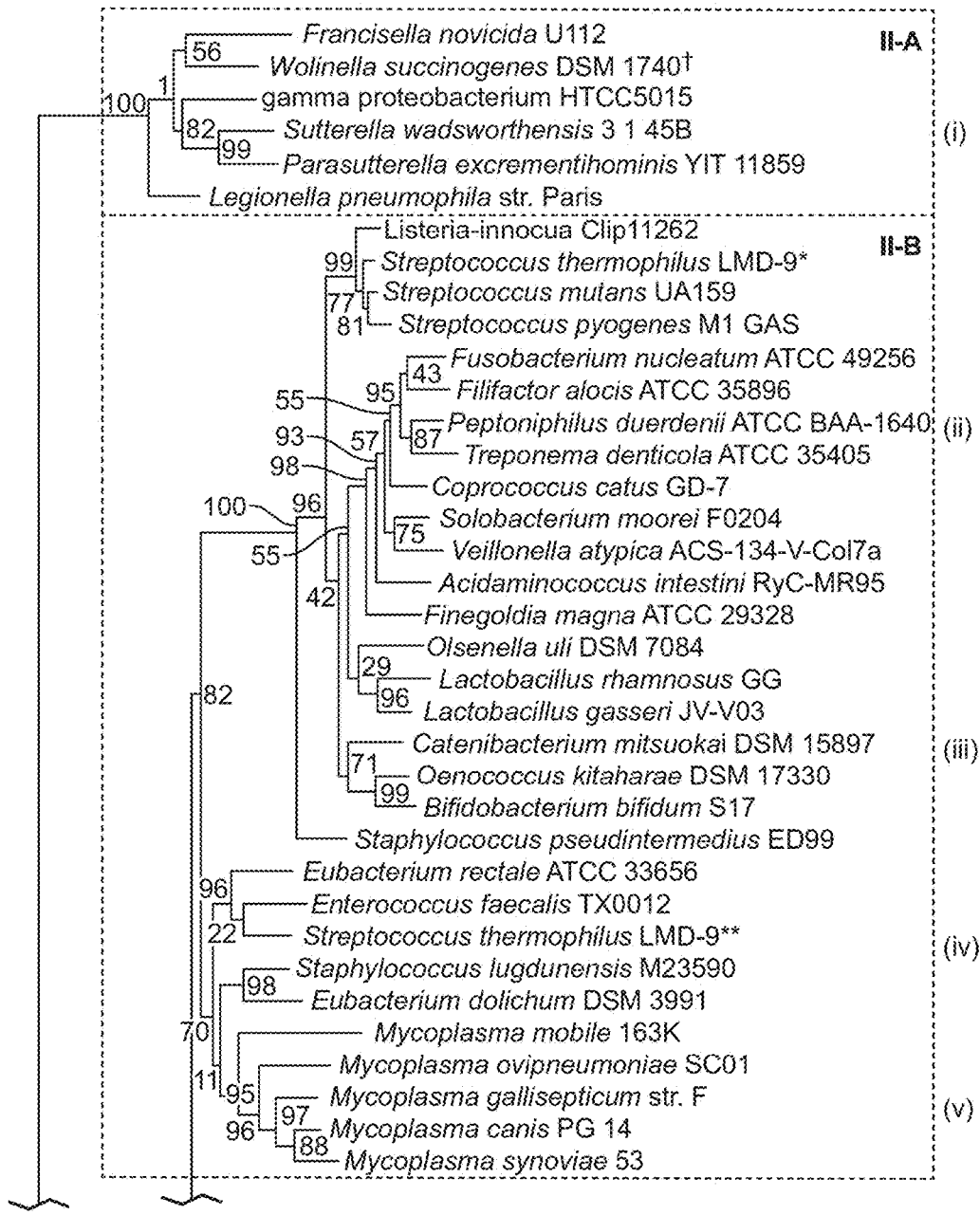
Figure 32A:
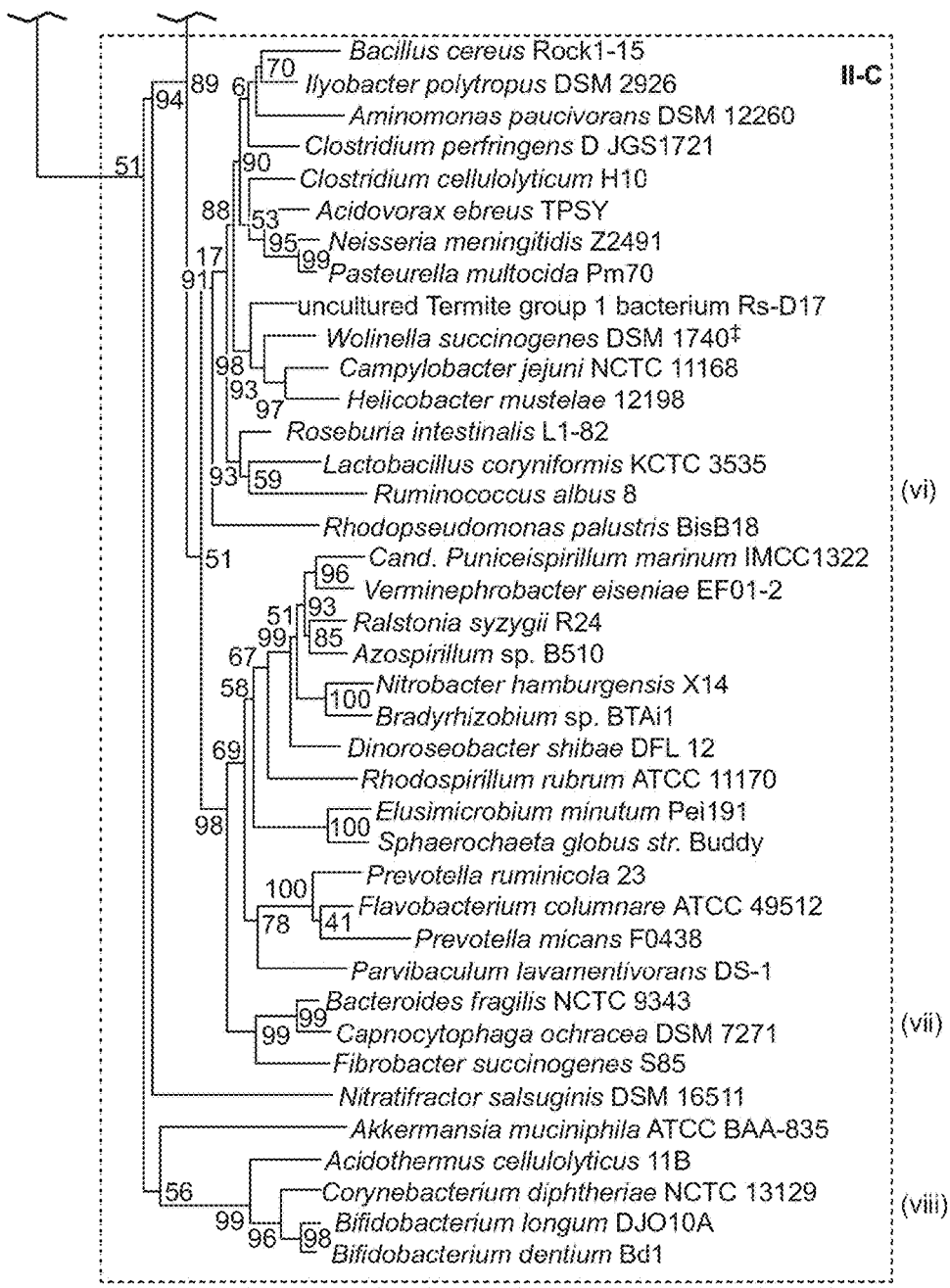
Figure 32B:
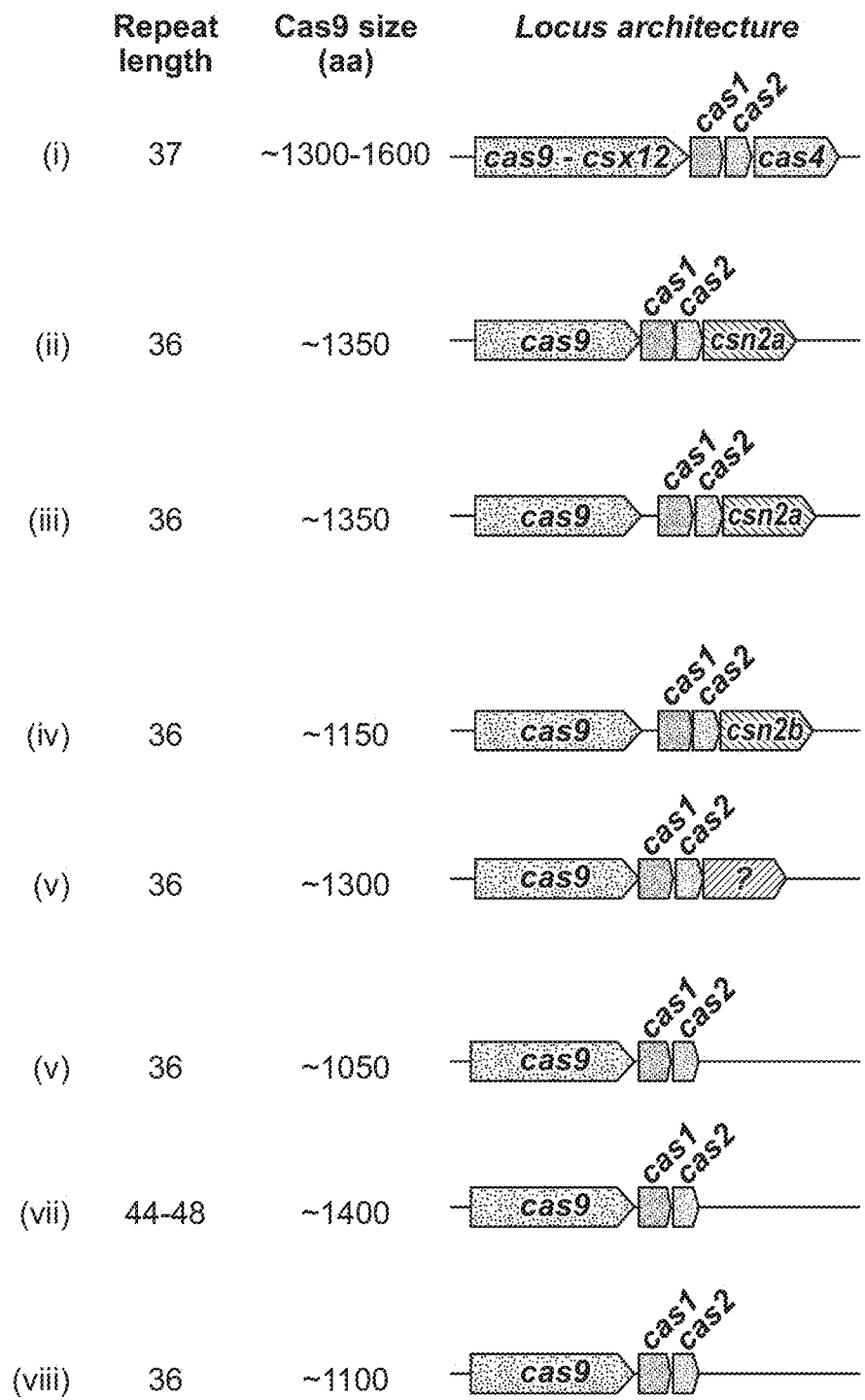
Figure 33A:
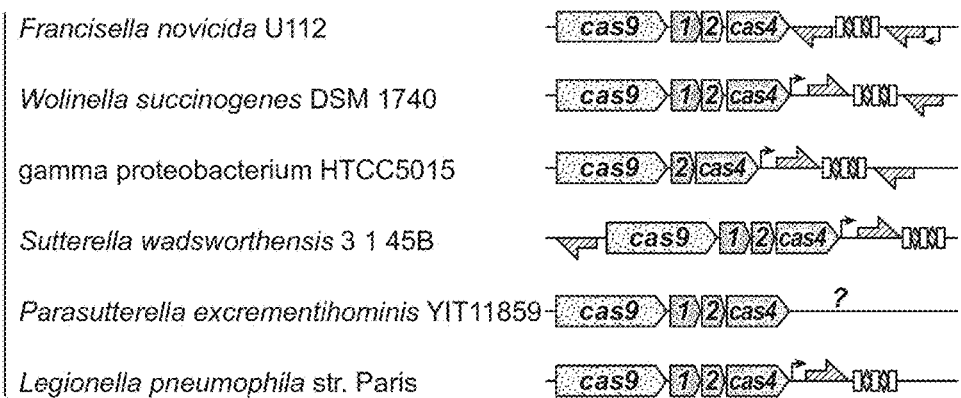
Figure 33B:
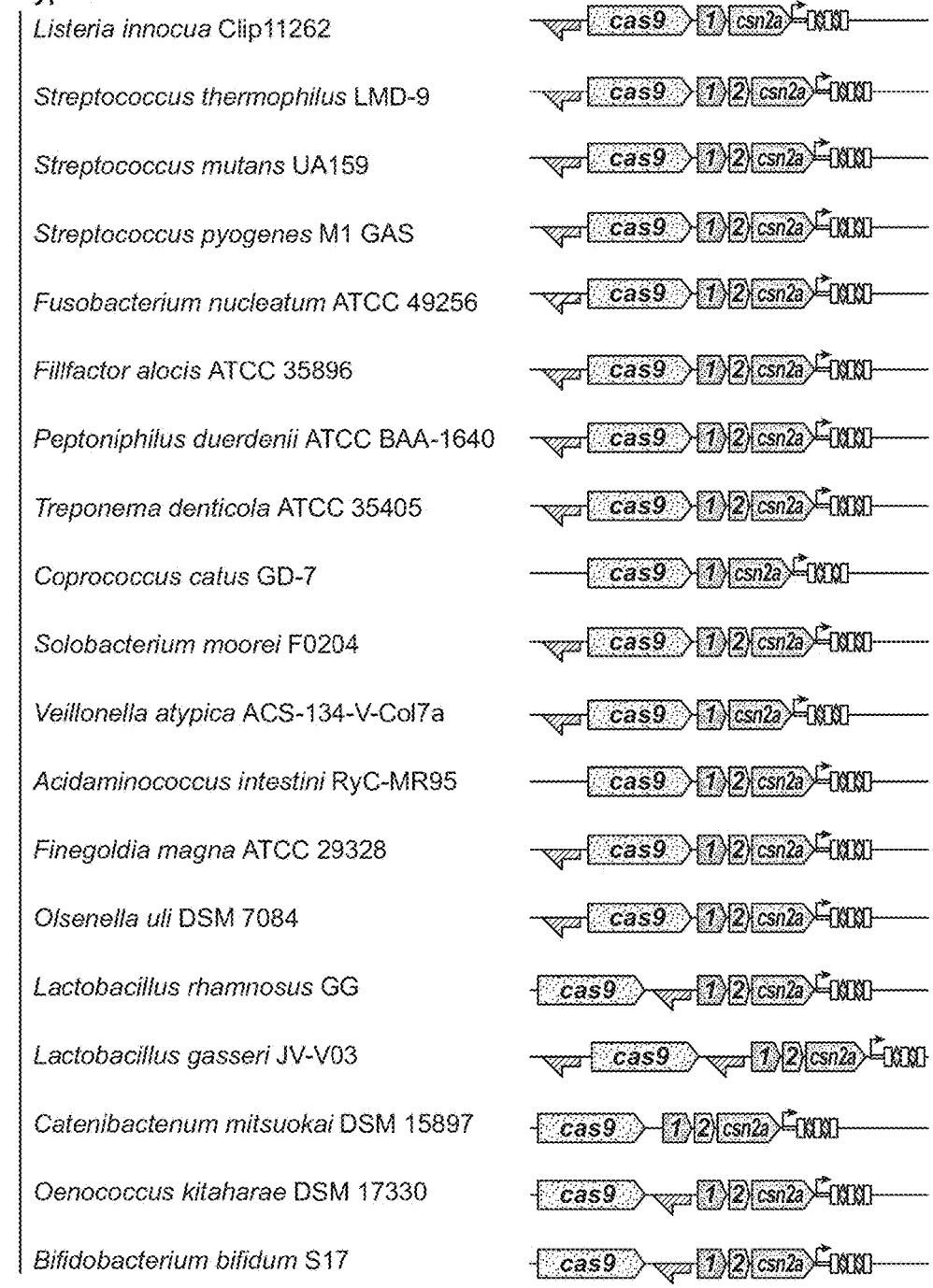
Figure 33C:
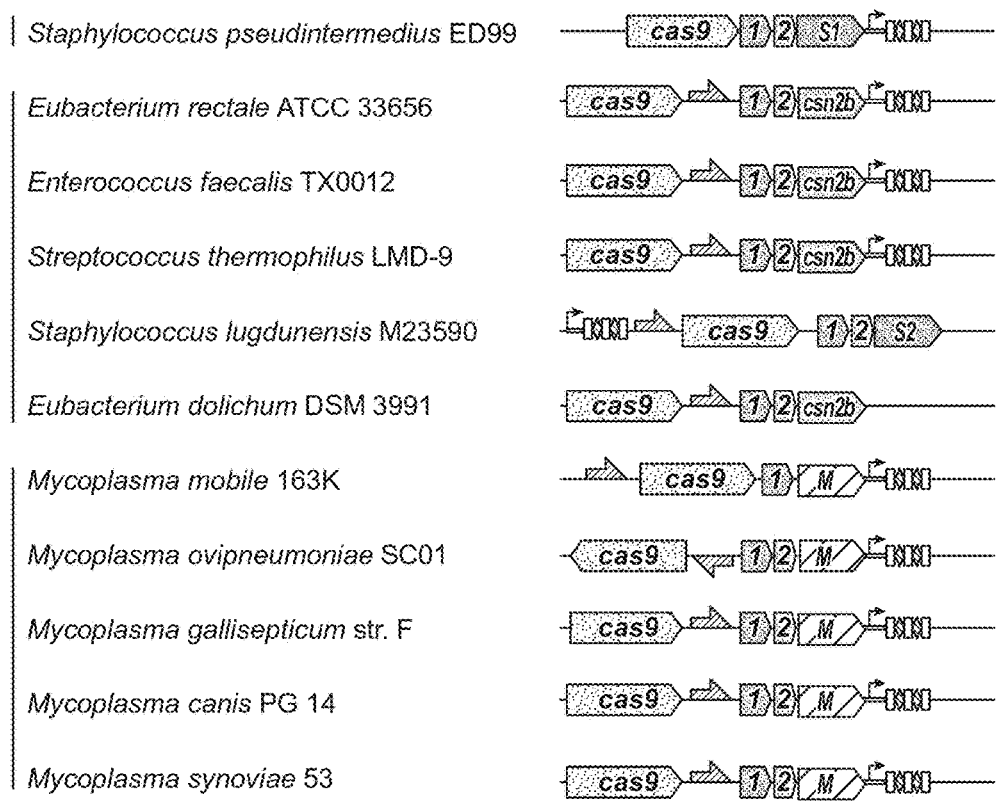
Figure 33D:
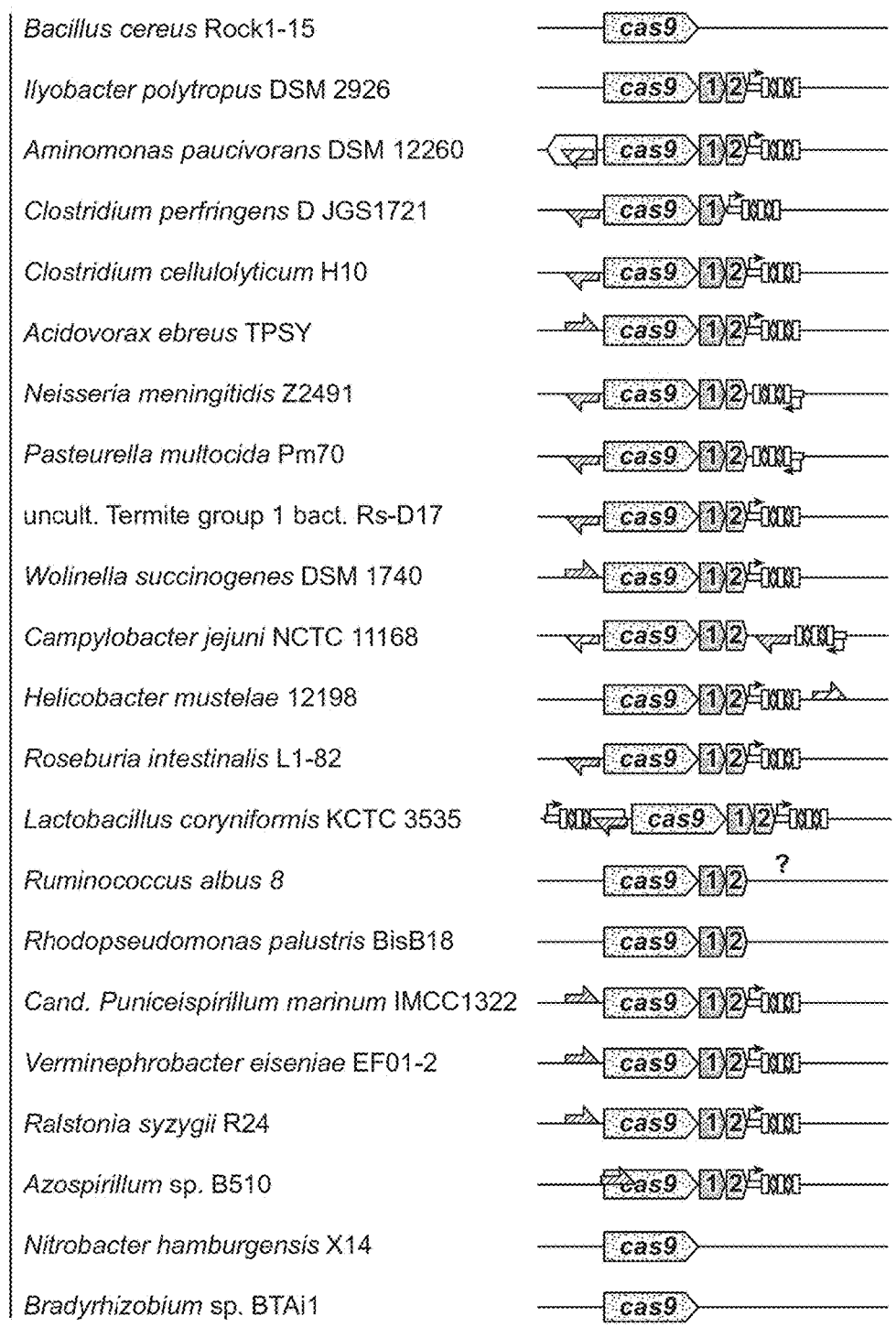
Figure 33E:
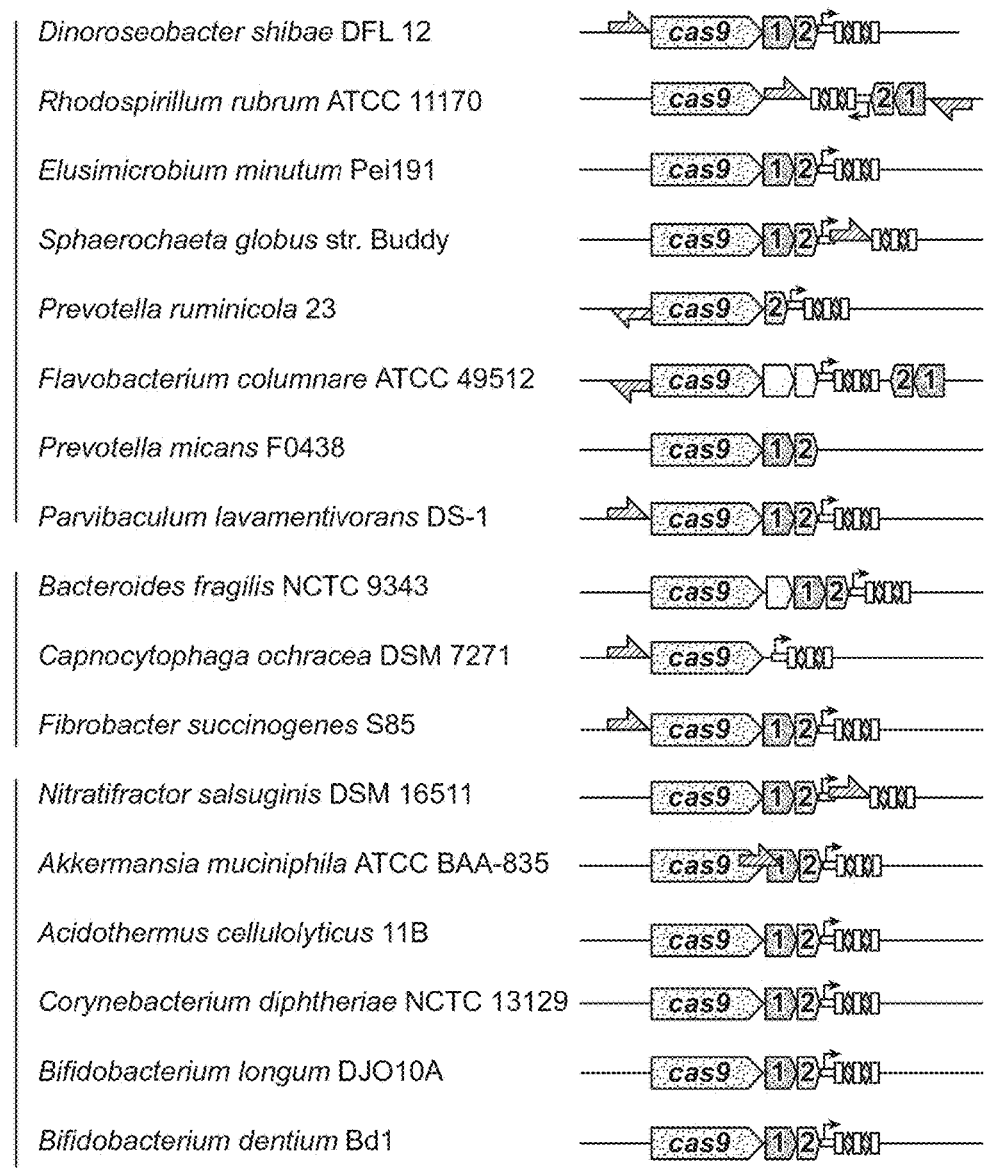

FIG. 32A-32B depict a phylogenetic tree of representative Cas9 sequences from various organisms (FIG. 32A) as well as Cas9 locus architectures for the main groups of the tree (FIG. 32B).

FIG. 33A-33E depict the architecture of type II CRISPR-Cas from selected bacterial species.

Figure 34B:
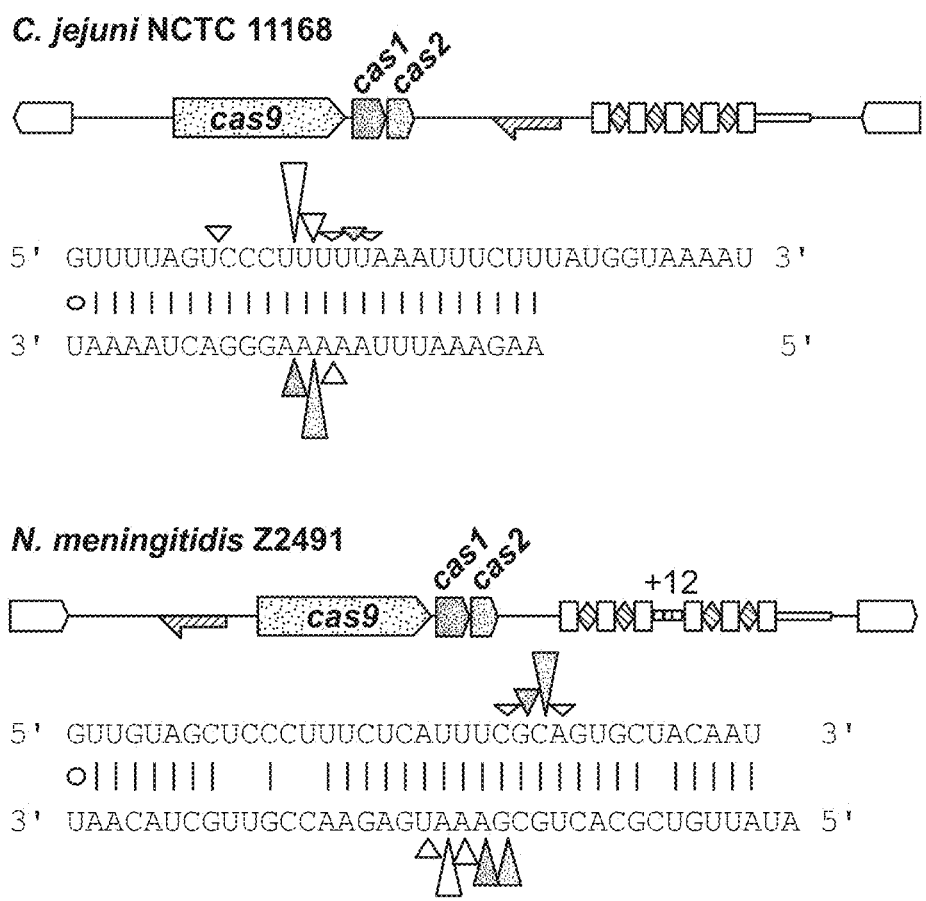

FIG. 34A-34B depict tracrRNA and pre-crRNA co-processing in selected type II CRISPR Cas systems. FIG. 34A (top to bottom, SEQ ID NO: 618, 442, 574, 443, 577, 447, 573, 481); FIG. 34B (top to bottom, SEQ ID NO: 598, 470, 579, 450).

Figure 35:
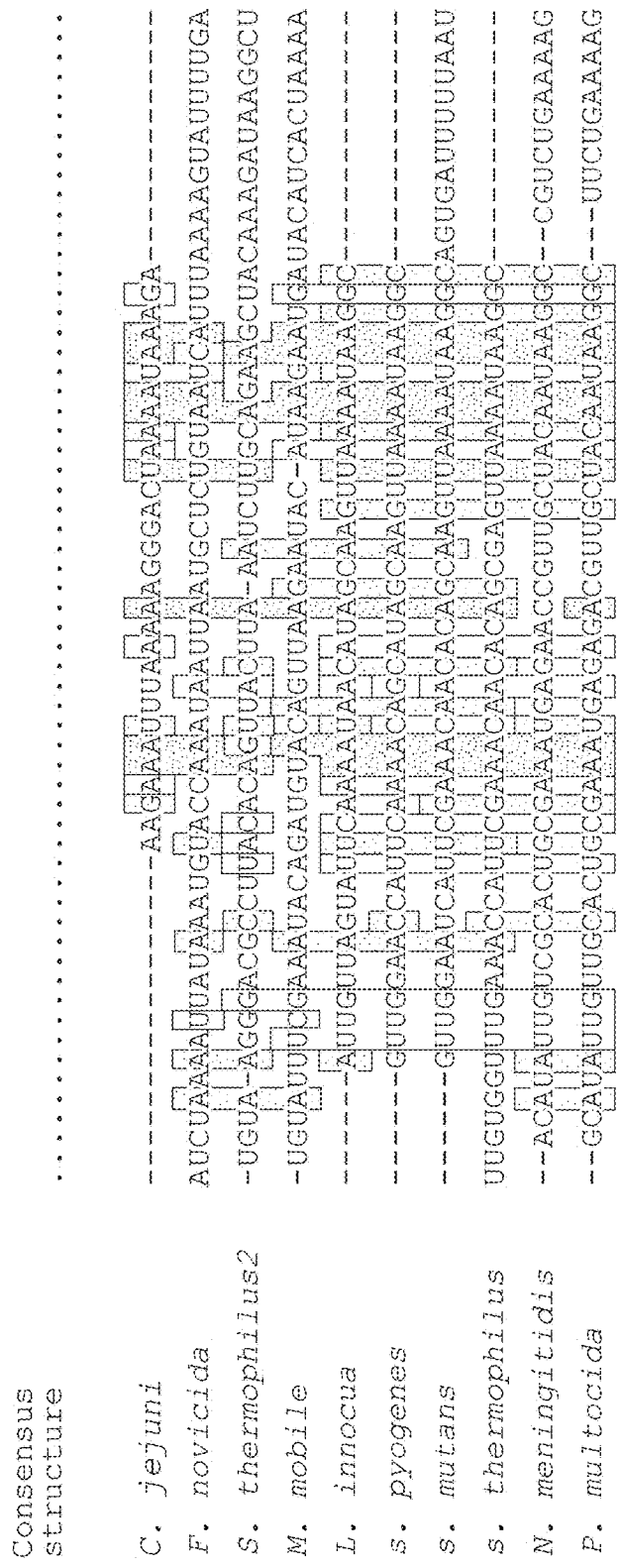
Figure 36A:
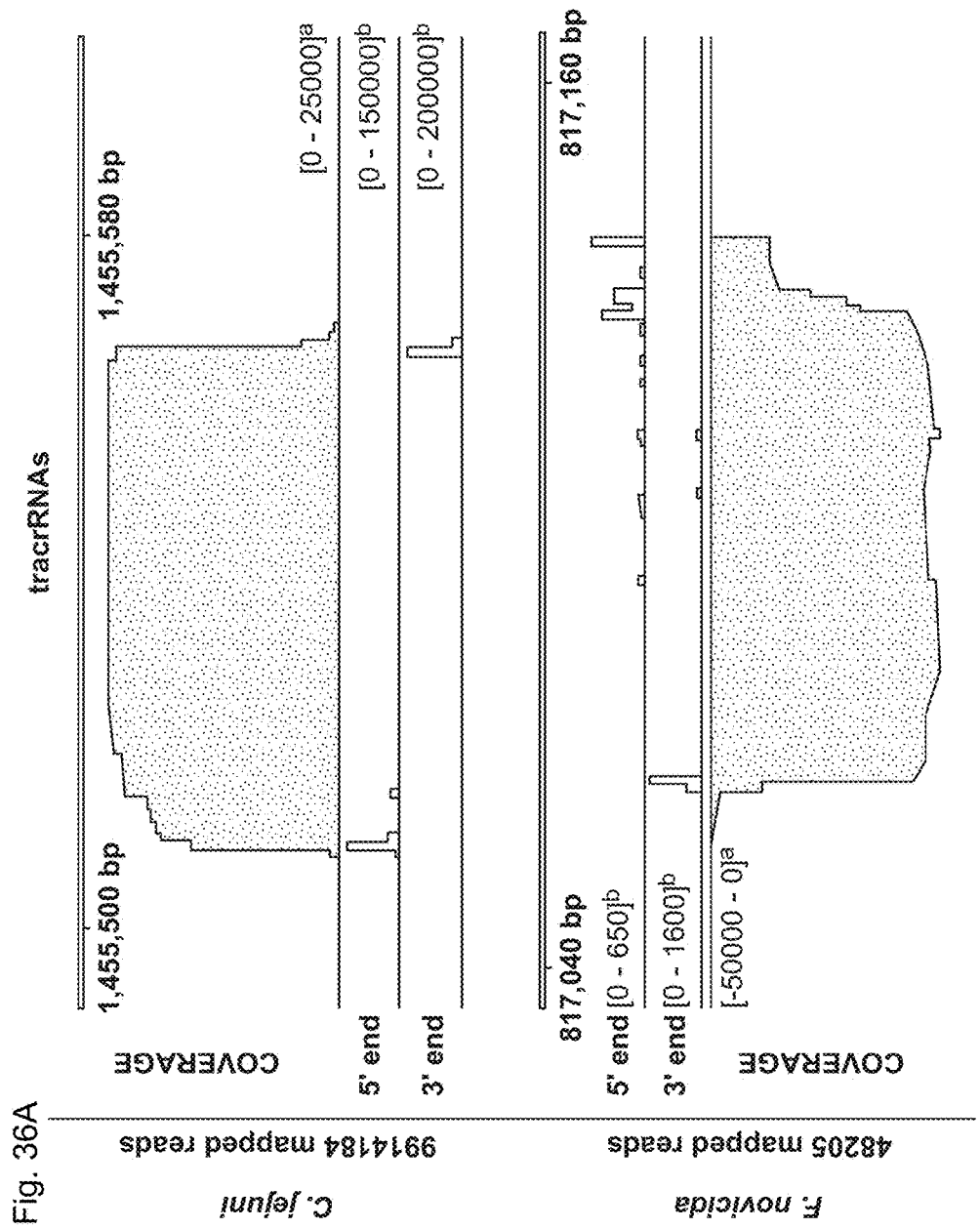
Figure 36B:
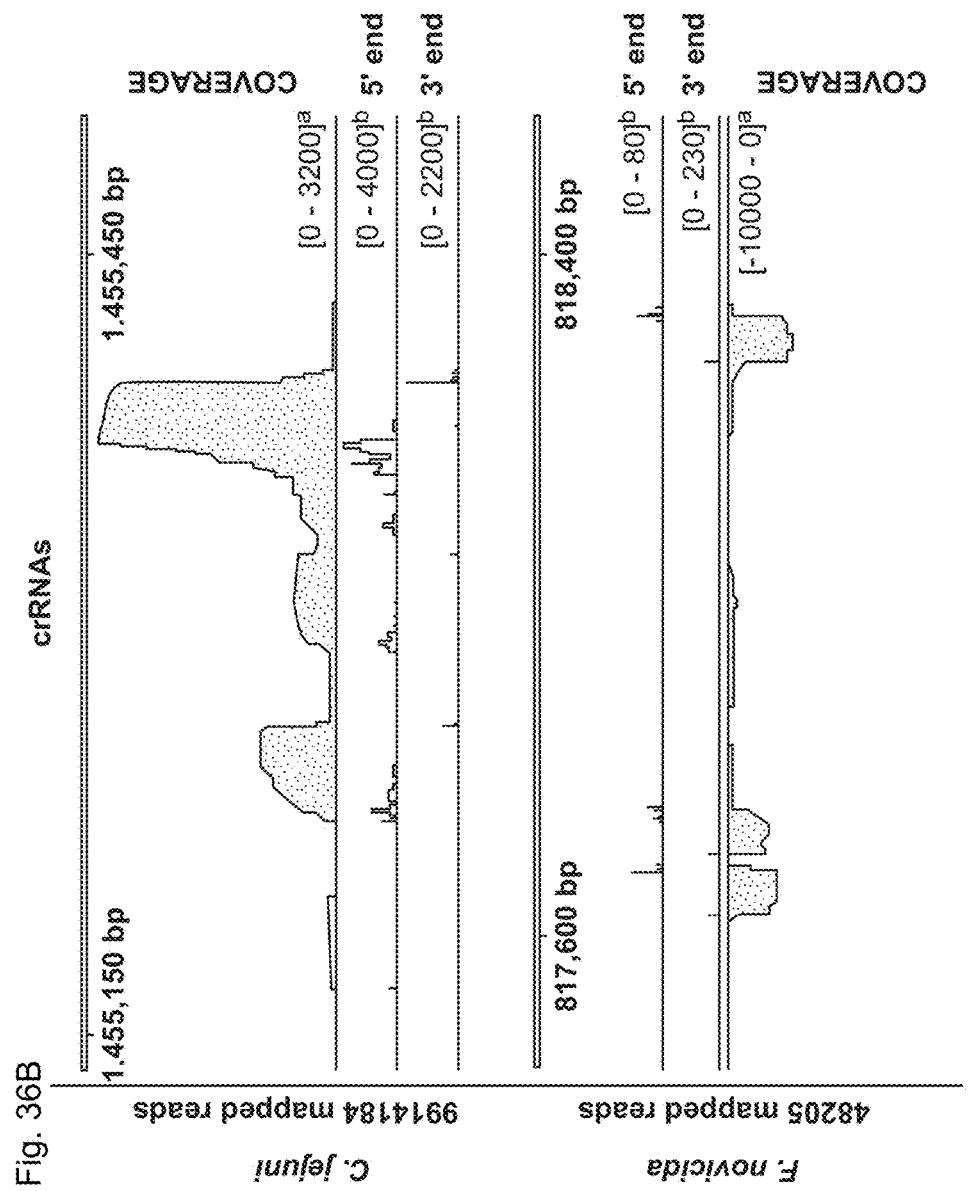
Figure 36C:
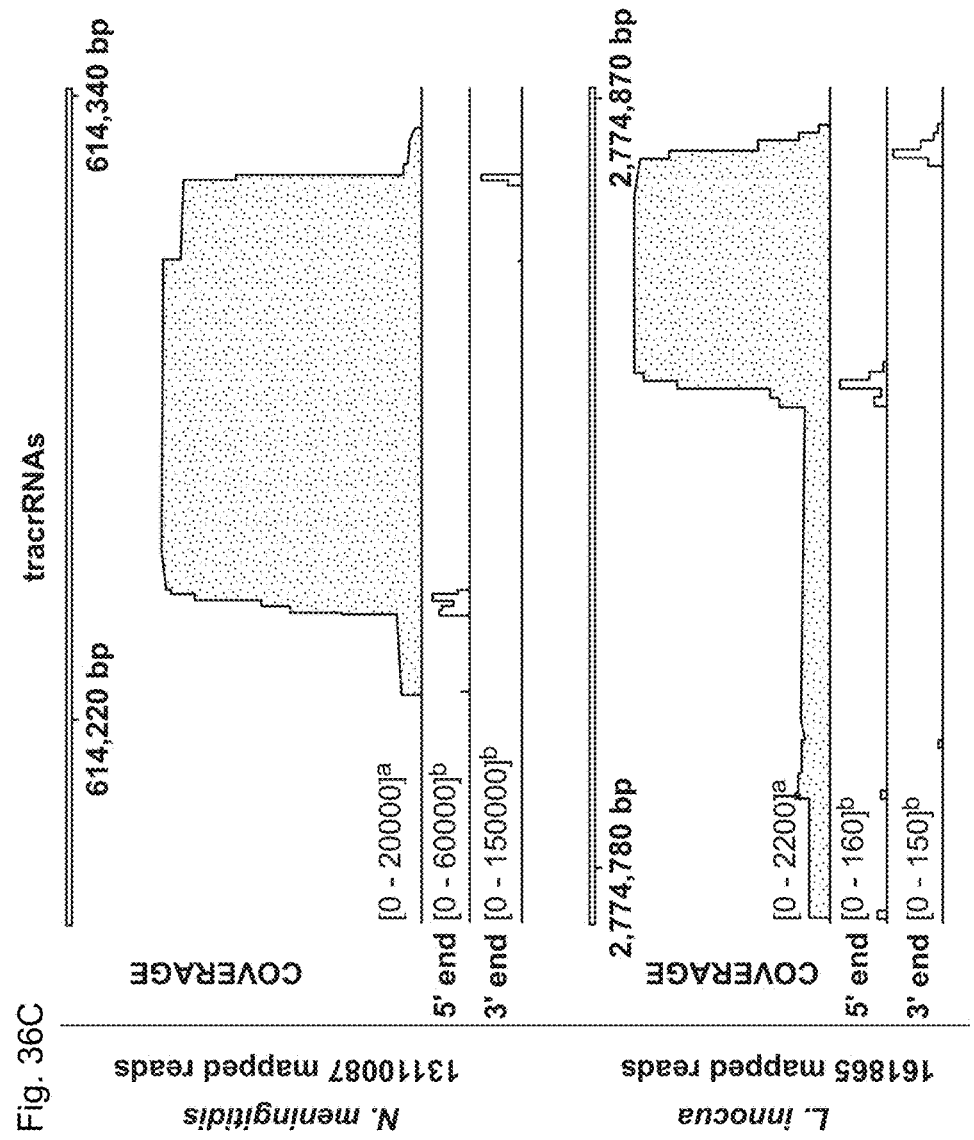
Figure 36D:
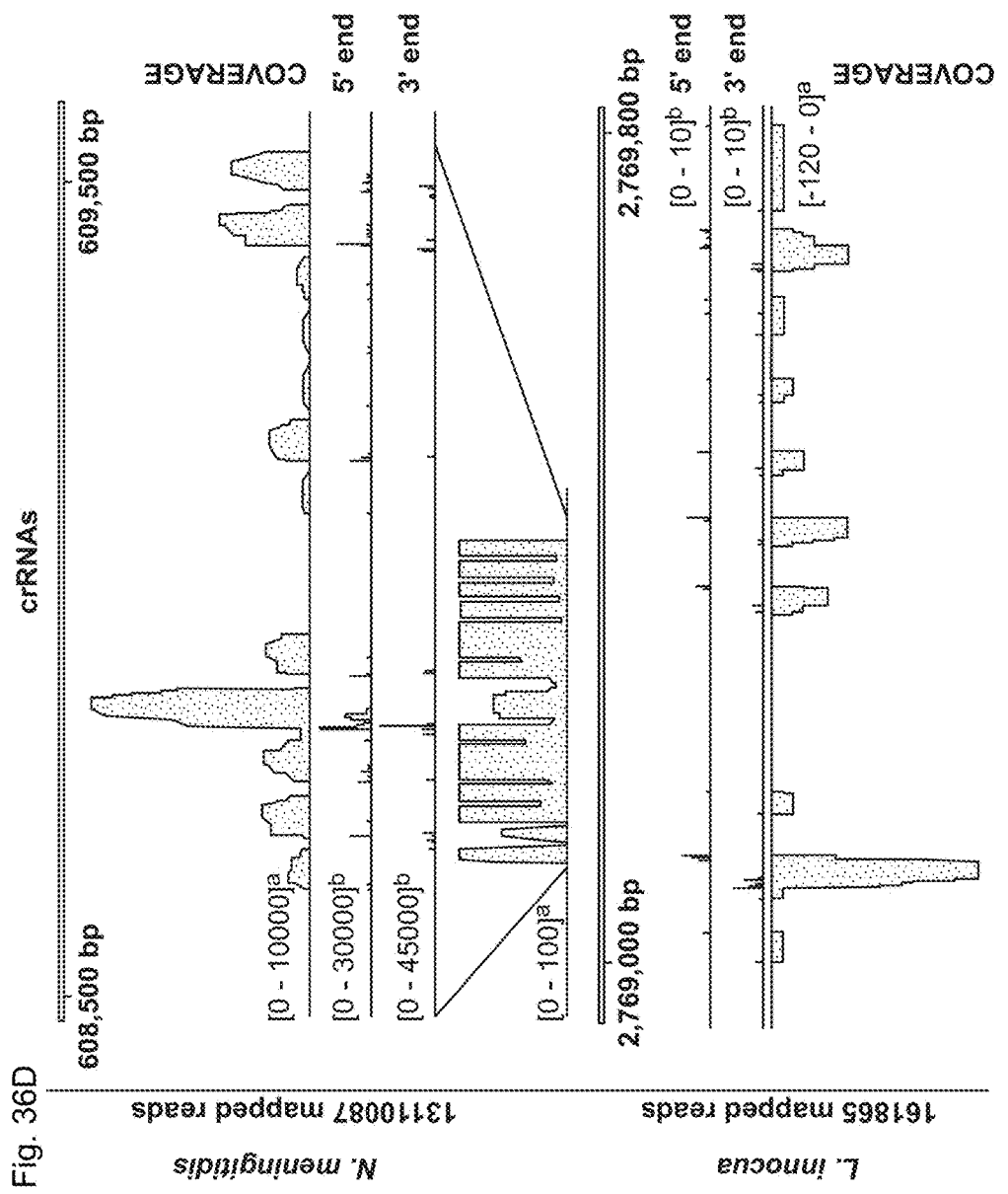
Figure 36E:
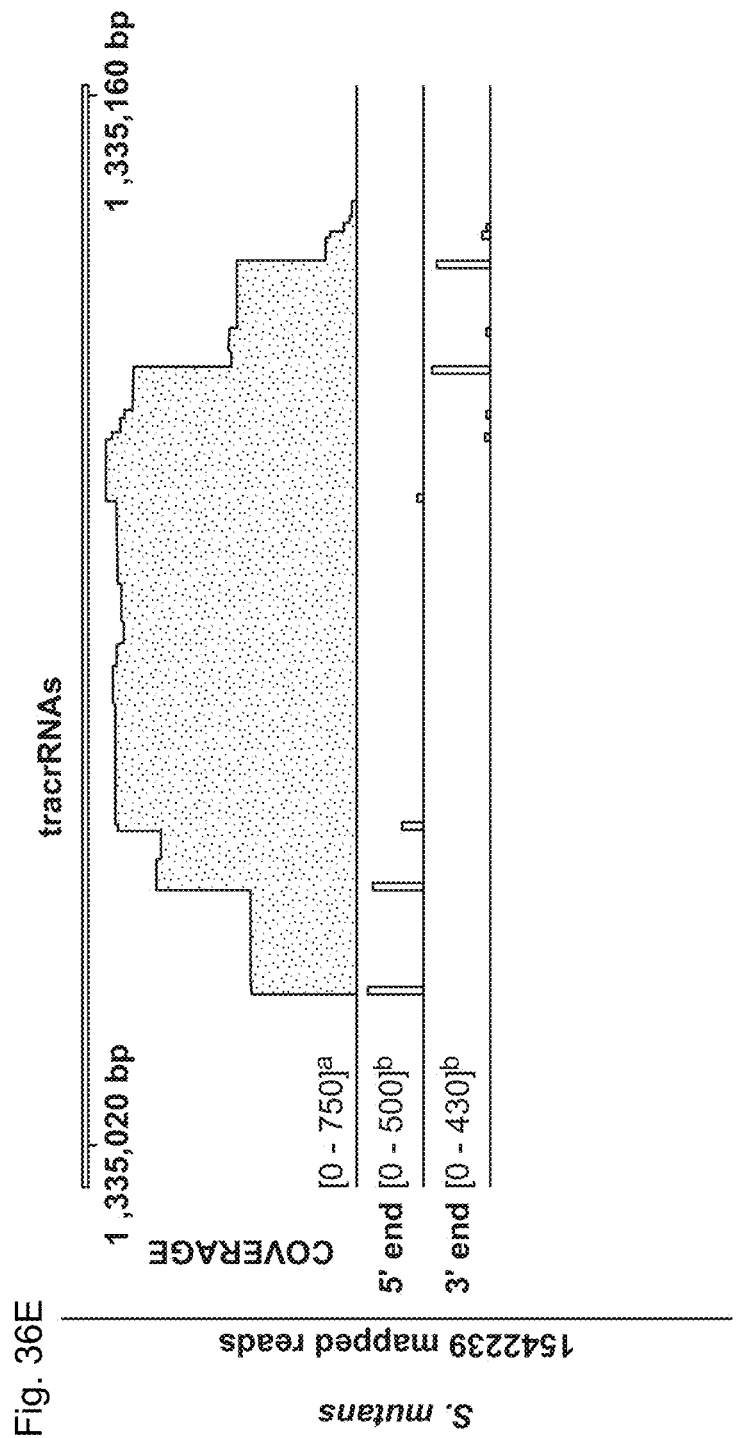
Figure 36F:
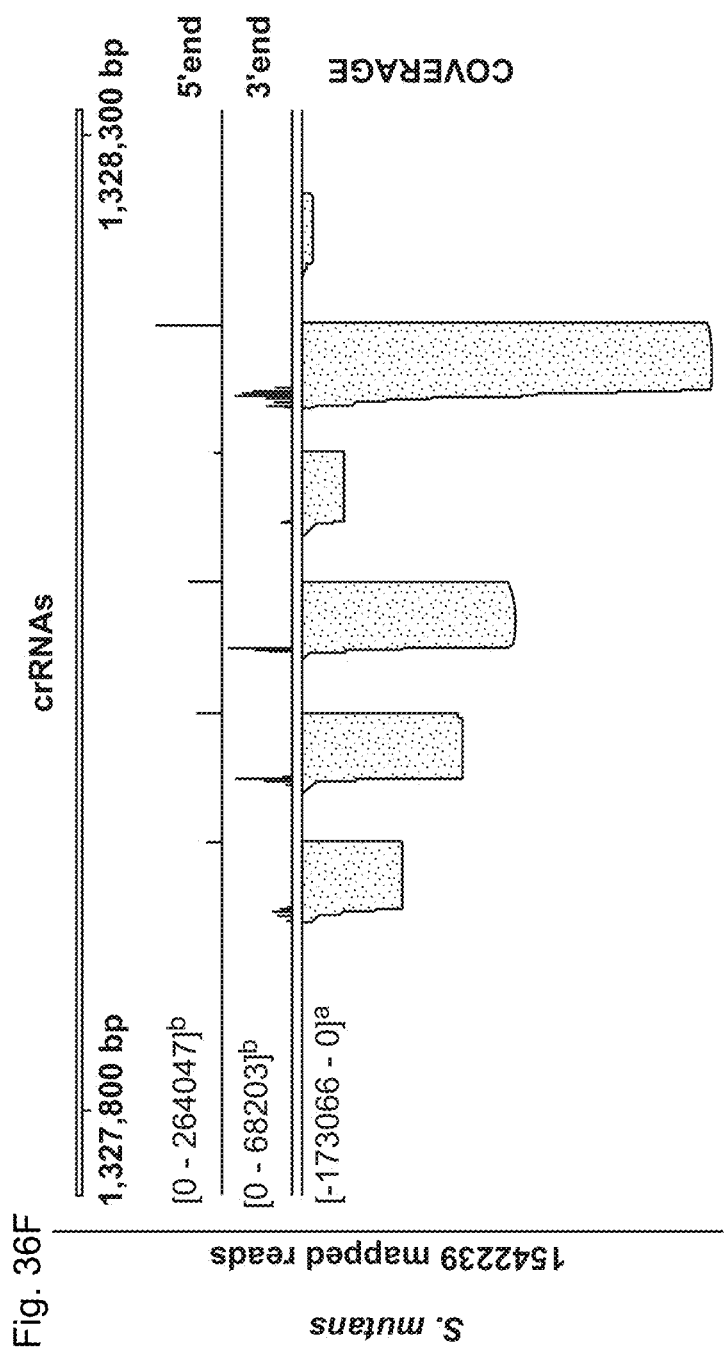

FIG. 35 depicts a sequence alignment of tracrRNA orthologues demonstrating the diversity of tracrRNA sequences.

FIG. 36A-36F depict the expression of bacterial tracrRNA orthologues and crRNAs revealed by deep RNA sequencing.

FIG. 37A-37O list all tracrRNA orthologues and mature crRNAs retrieved by sequencing for the bacterial species studied, including coordinates (region of interest) and corresponding cDNA sequences (5' to 3').

FIG. 38A-38B present a table of bacterial species containing type II CRISPR-Cas loci characterized by the presence of the signature gene cas9. These sequences were used for phylogenetic analyses.

Figure 39A:
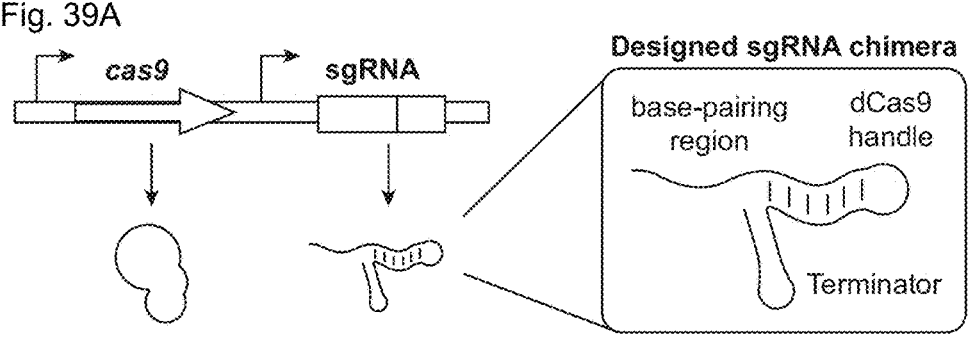
Figure 39B:
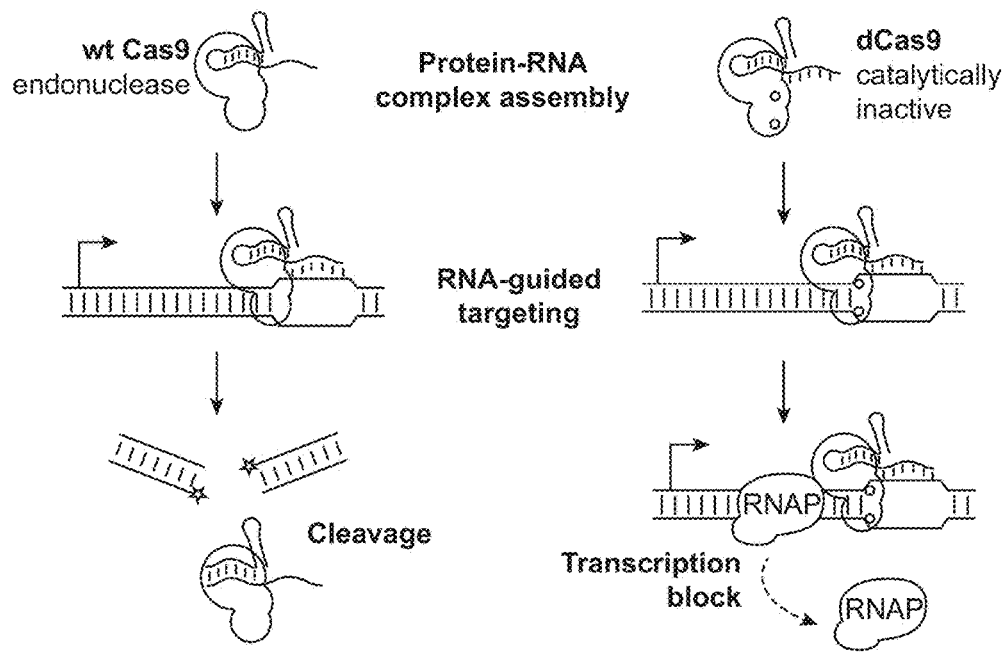

FIG. 39A-39B depict the design of the CRISPR interference (CRISPRi) system.

FIG. 40A-40E demonstrate that CRISPRi effectively silences transcription elongation and initiation.

Figure 41A:
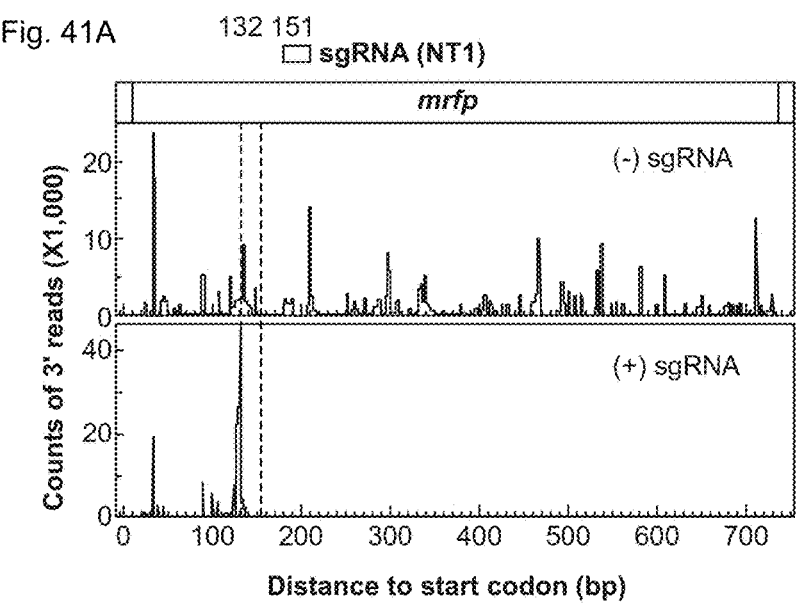
Figure 41B:
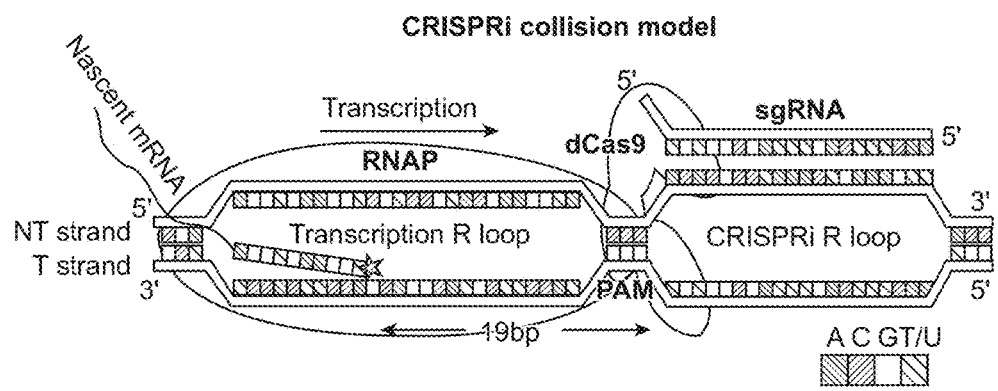

FIG. 41A-41B demonstrate that CRISPRi functions by blocking transcription elongation.

FIG. 42A-42C demonstrate the targeting specificity of the CRISPRi system.

FIG. 43A-43F depict the characterization of factors that affect silencing efficiency.

Figure 44A:
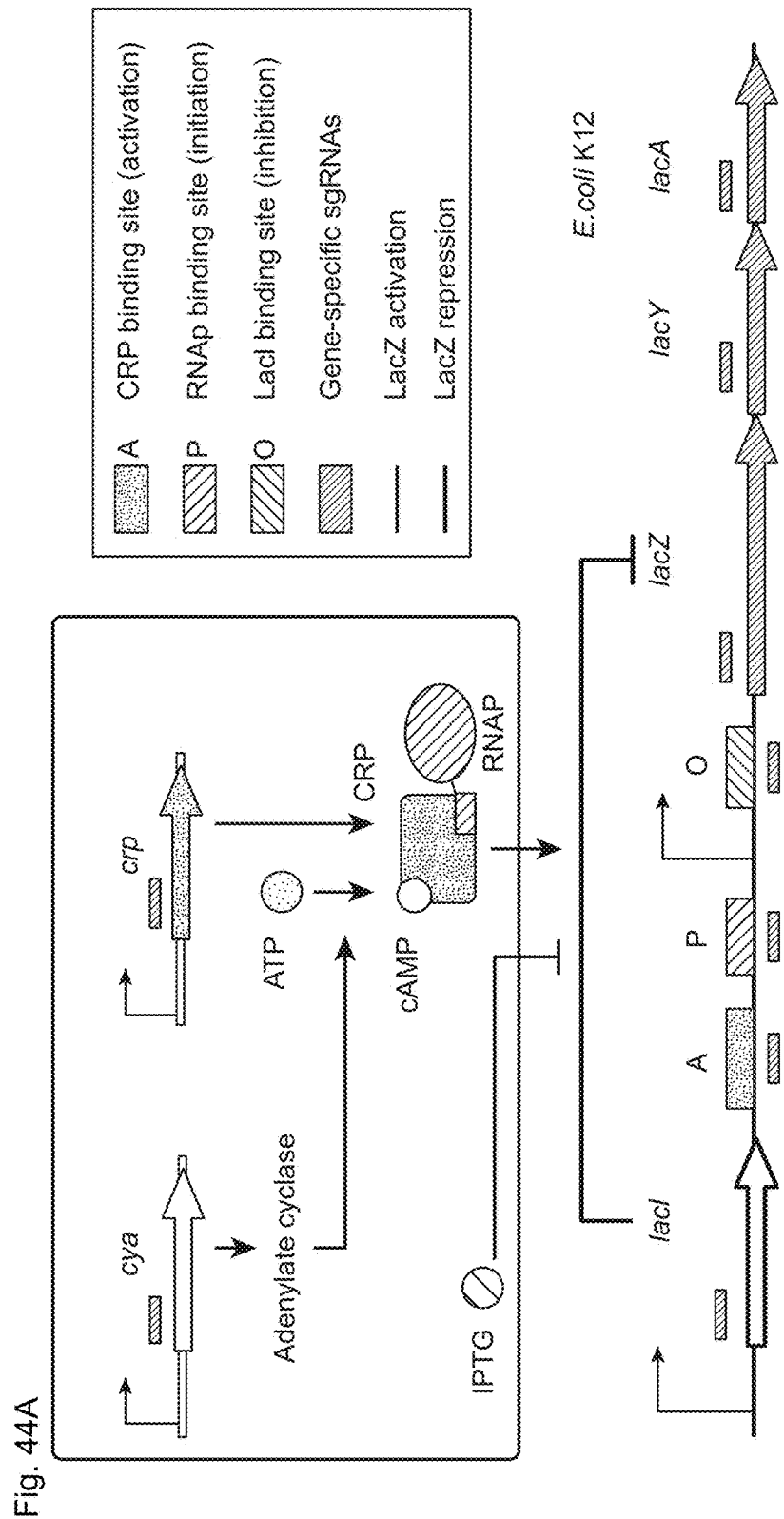
Figure 44B:
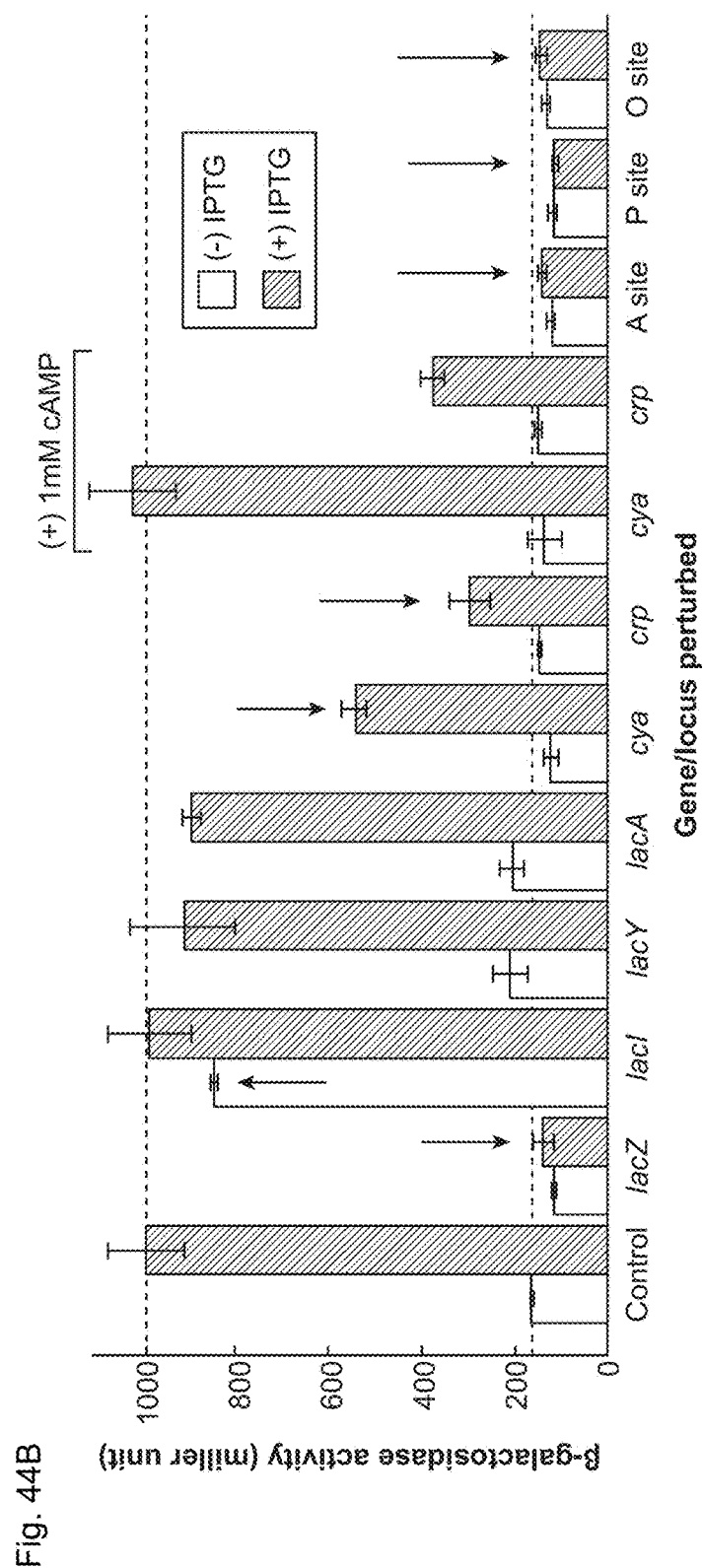

FIG. 44A-44C depict functional profiling of a complex regulatory network using CRISPRi gene knockdown.

FIG. 45A-45B demonstrates gene silencing using CRISPRi in mammalian cells.

Figure 46:
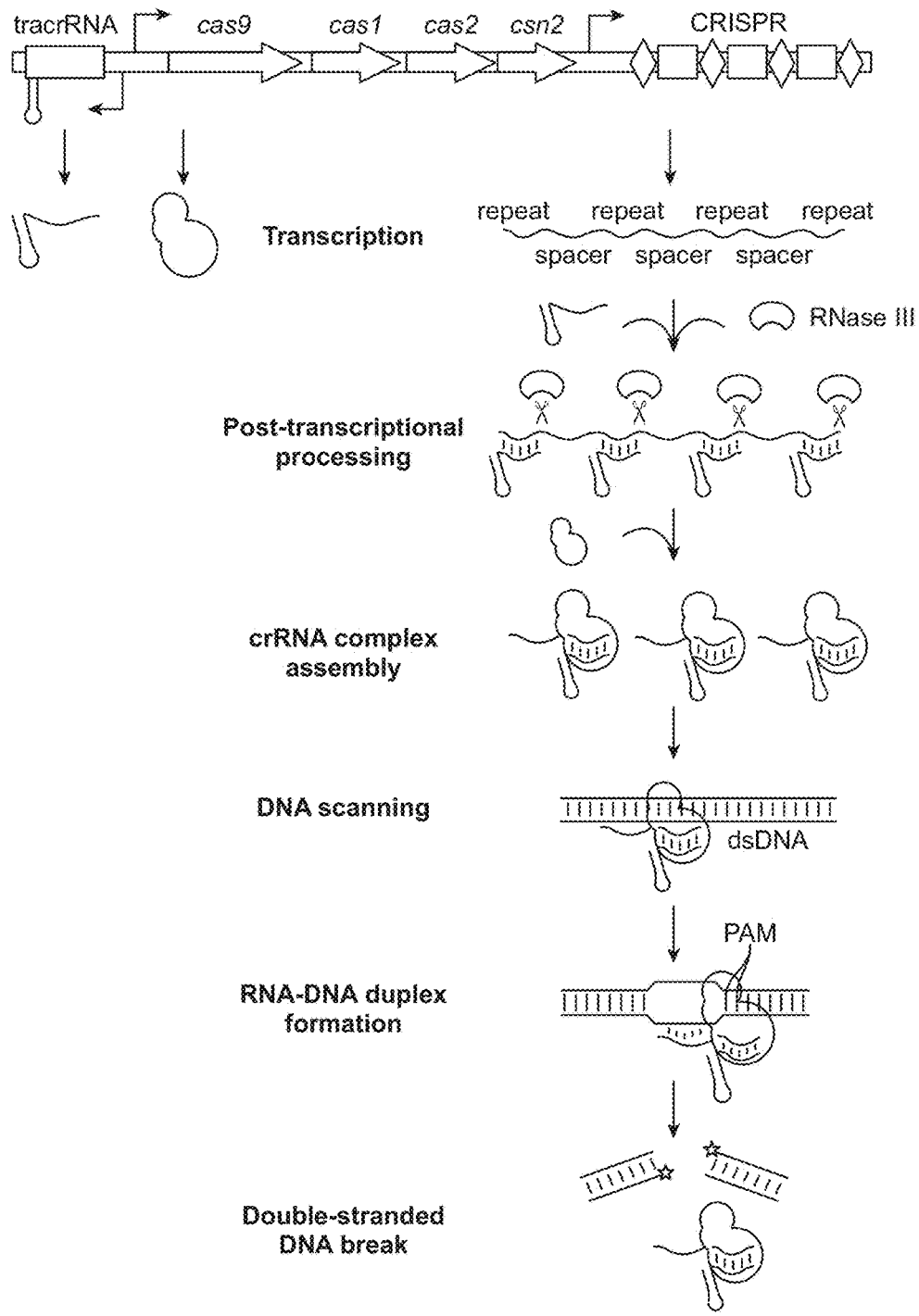

FIG. 46 depicts the mechanism of the type II CRISPR system from *S. pyogenes*.

Figure 47A:
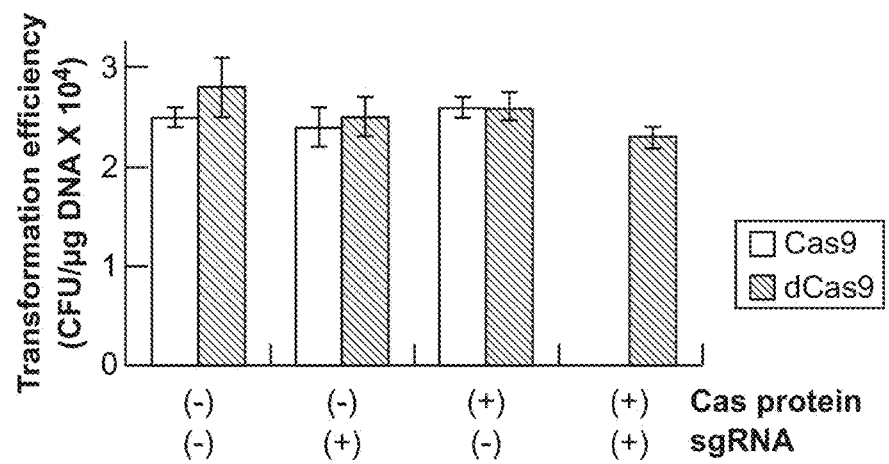
Figure 47B:
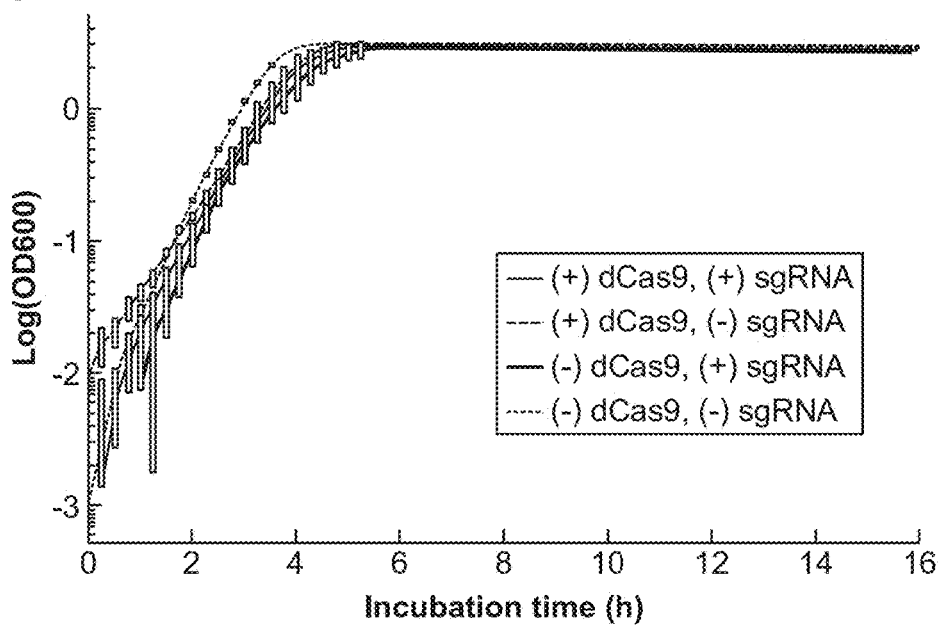

FIG. 47A-47B depict the growth curves of *E. coli* cell cultures co-transformed with dCas9 and sgRNA.

Figure 48:
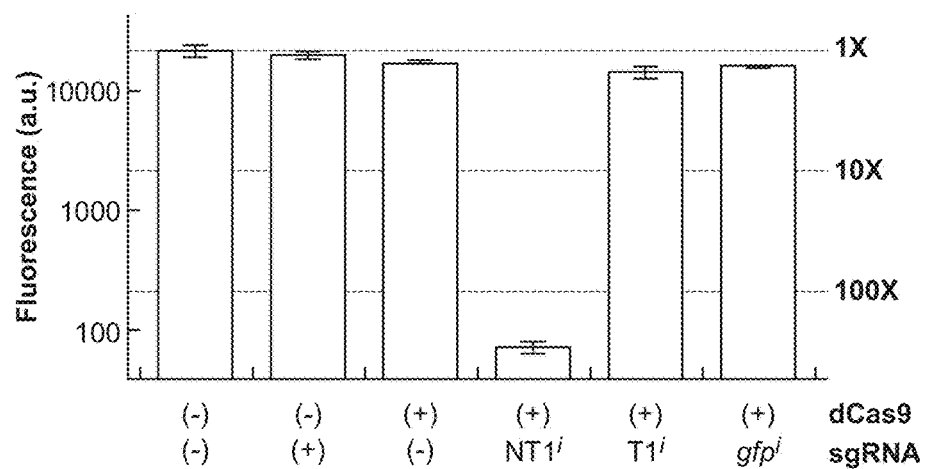

FIG. 48 shows that CRISPRi could silence expression of a reporter gene on a multiple-copy plasmid.

Figure 49A:
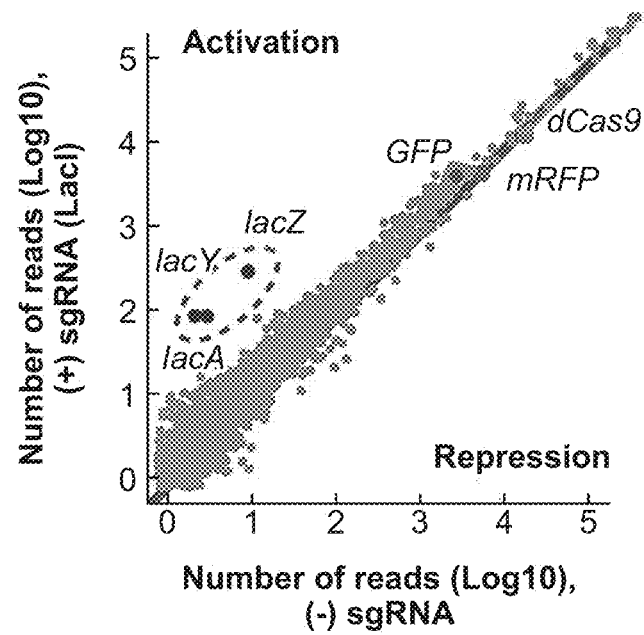
Figure 49B:
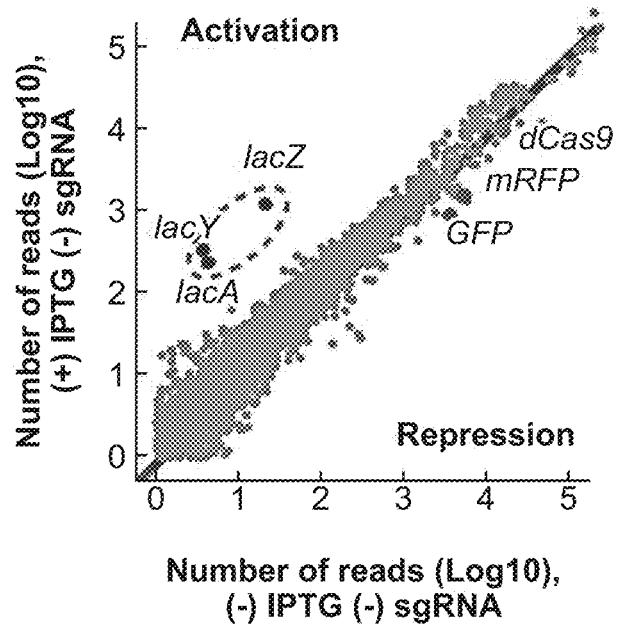
Figure 49C:
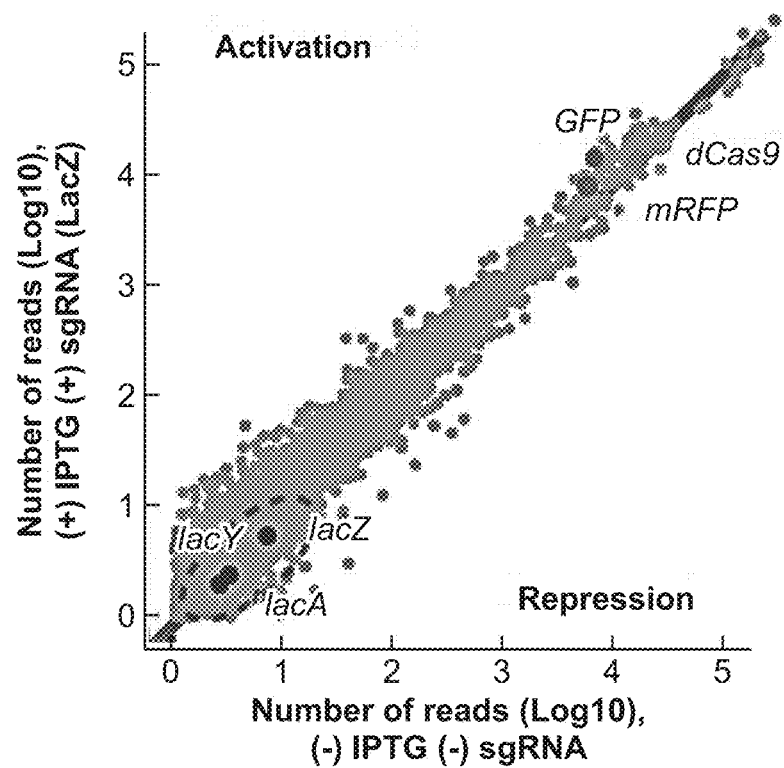
Figure 50A:
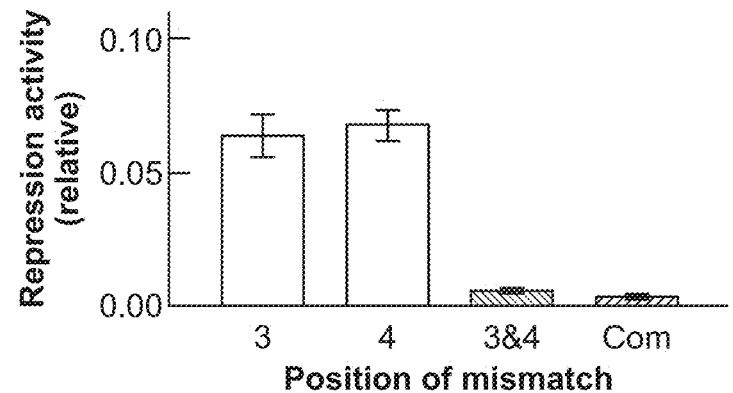
Figure 50B:
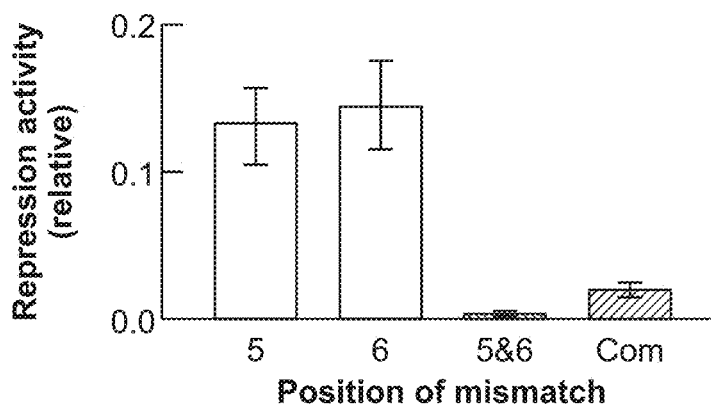
Figure 50C:
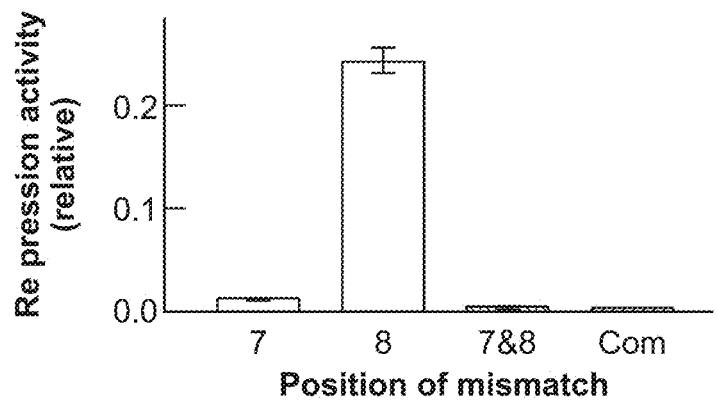
Figure 50D:
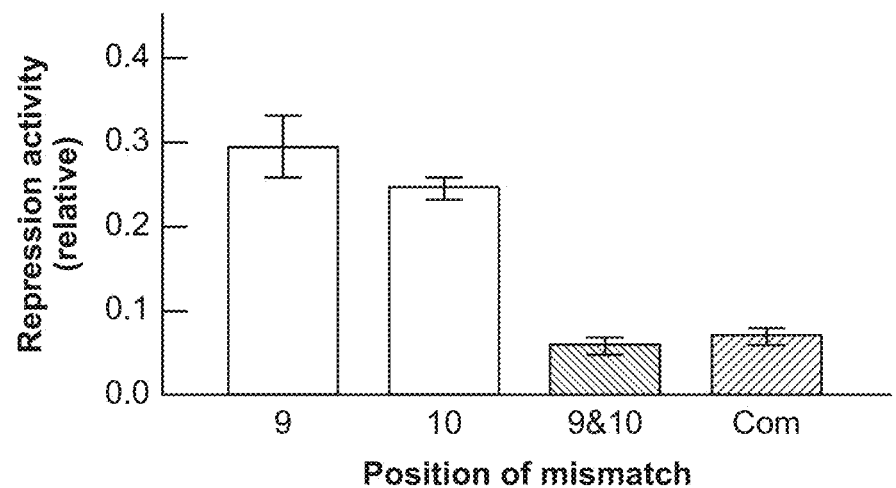
Figure 50E:
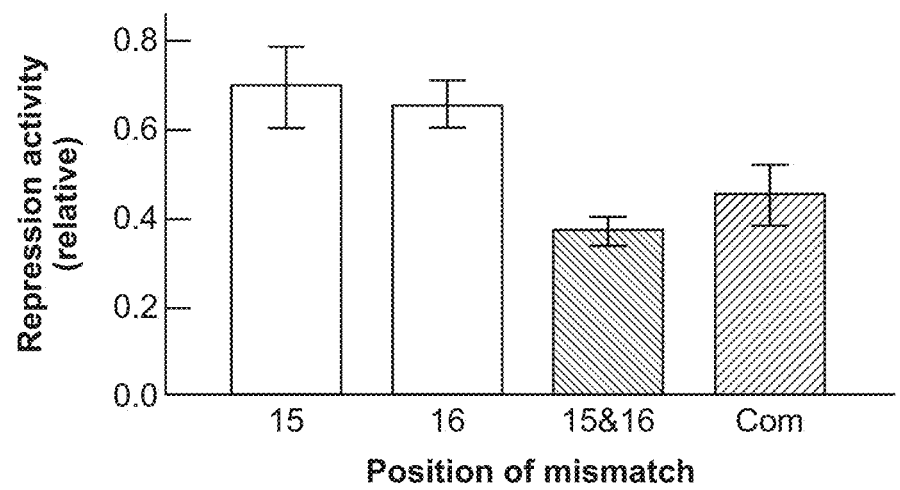

FIG. 49A-49C depict the RNA-seq data of cells with sgRNAs that target different genes.

FIG. 50A-50E depict the silencing effects of sgRNAs with adjacent double mismatches.

FIG. 51A-51C depict the combinatorial silencing effects of using two sgRNAs to regulate a single gene.

FIG. 52 shows that sgRNA repression is dependent on the target loci and relatively distance from the transcription start.

Figure 53A:
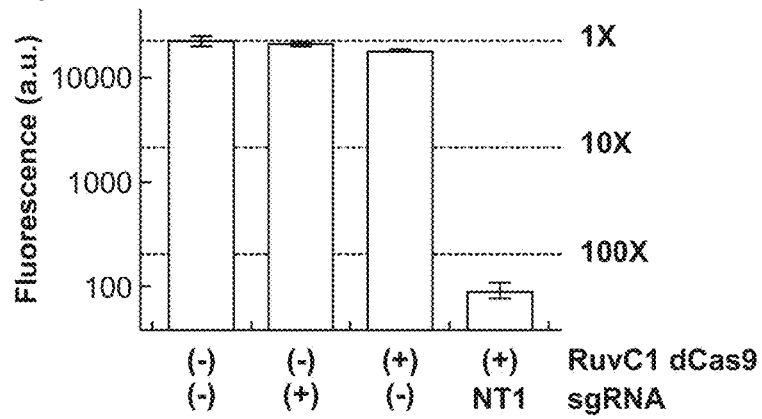
Figure 53B:
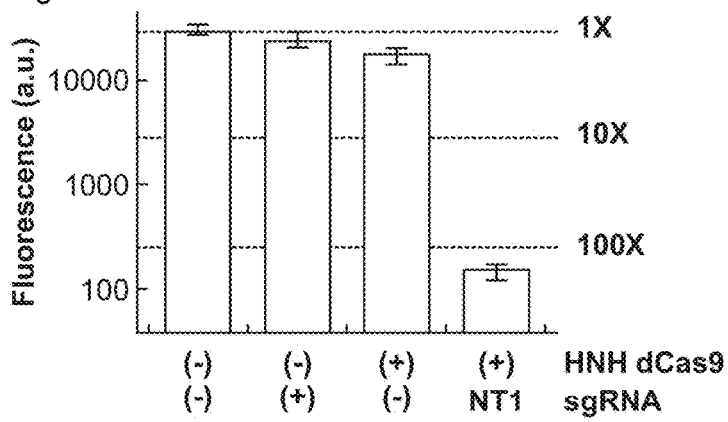
Figure 53C:
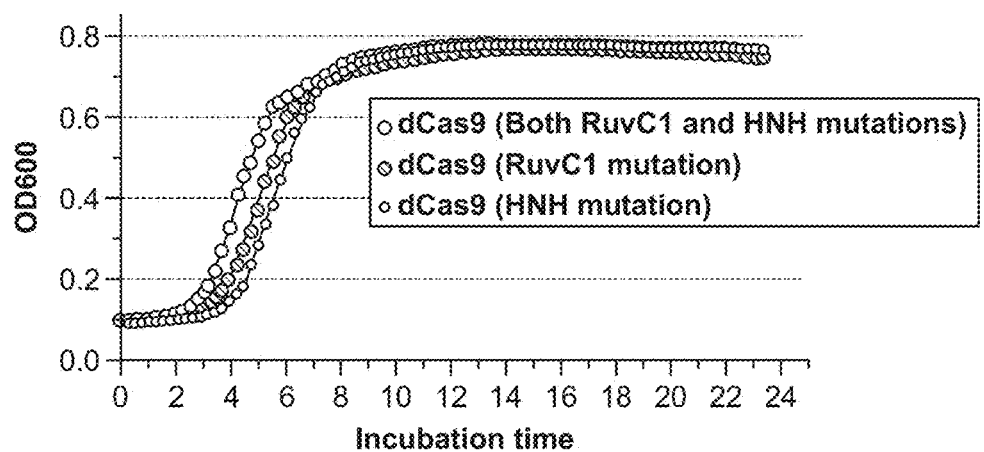
Figure 55A:
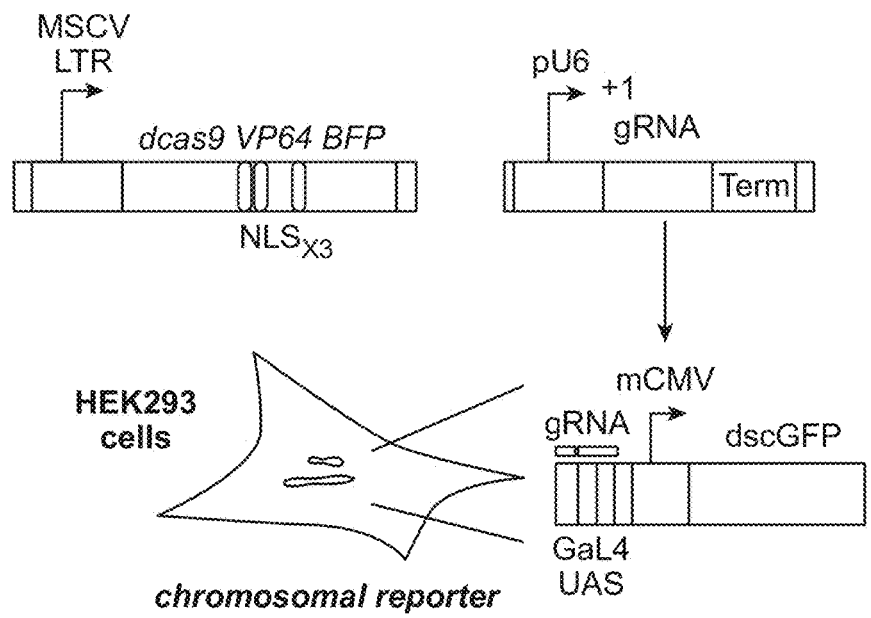
Figure 55B:
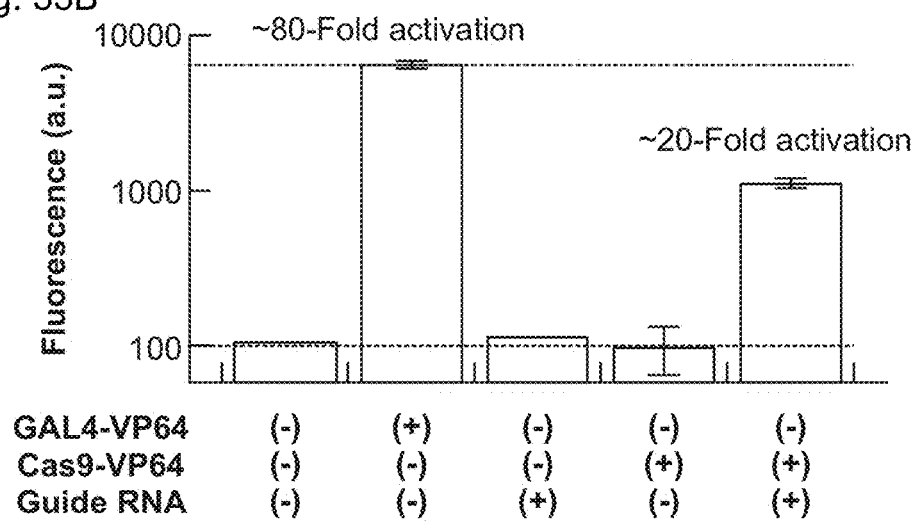
Figure 55C:
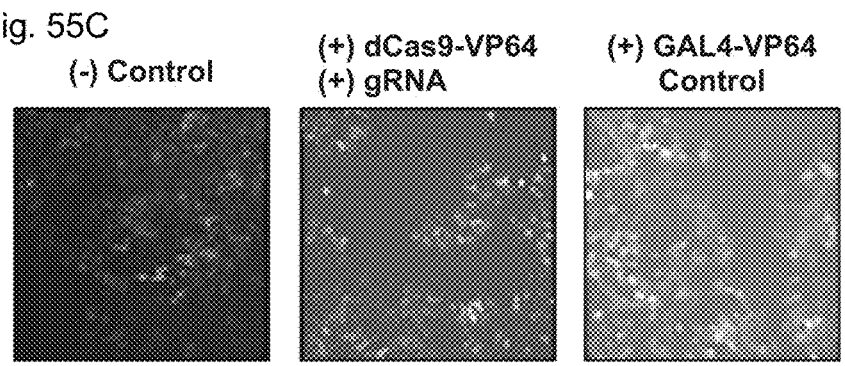
Figure 55D:
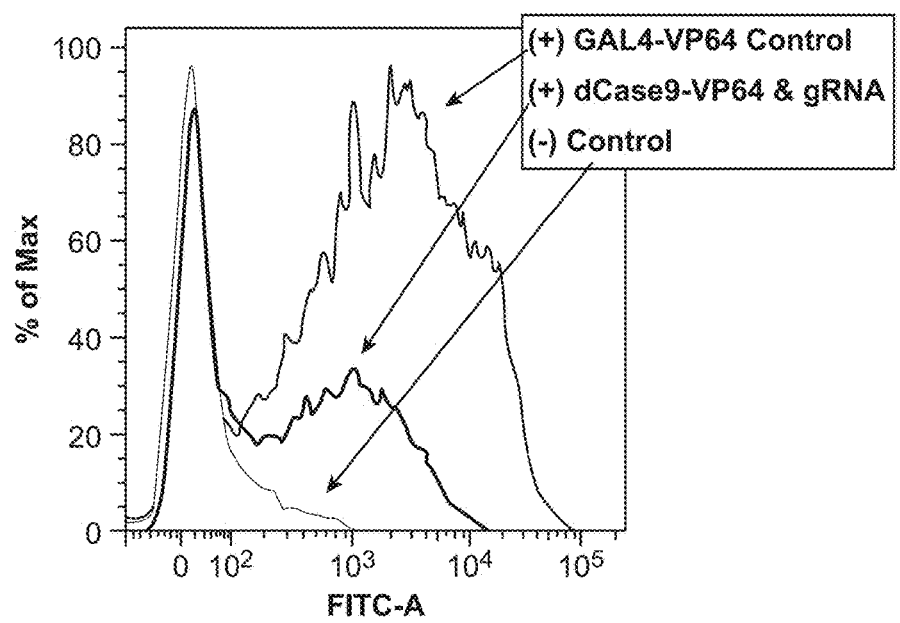

FIG. 53A-53C depict experimental results demonstrating that a variant Cas9 site-directed polypeptide (dCas9) is works for the subject methods when dCas9 has reduced activity in the RuvC1 domain only (e.g., D10A), the HNH domain only (e.g., H840A), or both domains (e.g, D10A and H840A).

FIG. 54A-54C list examples of suitable fusion partners (or fragments thereof) for a subject variant Cas9 site-directed polypeptide. Examples include, but are not limited to those listed.

FIG. 55A-55D demonstrate that a chimeric site-directed polypeptide can be used to activate (increase) transcription in human cells.

Figure 56:
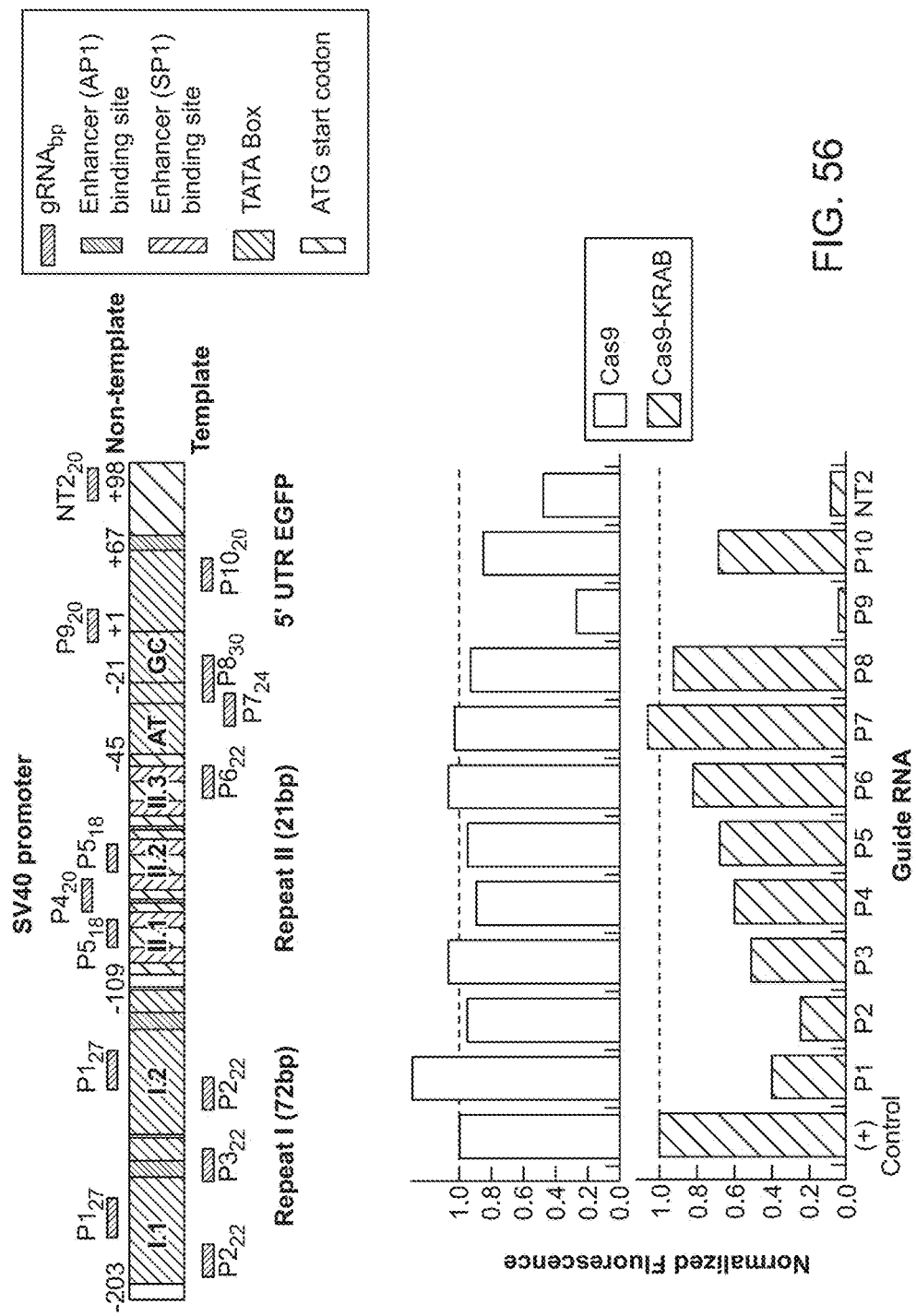

FIG. 56 demonstrates that a chimeric site-directed polypeptide can be used to repress (decrease) transcription in human cells.

Figure 57A:
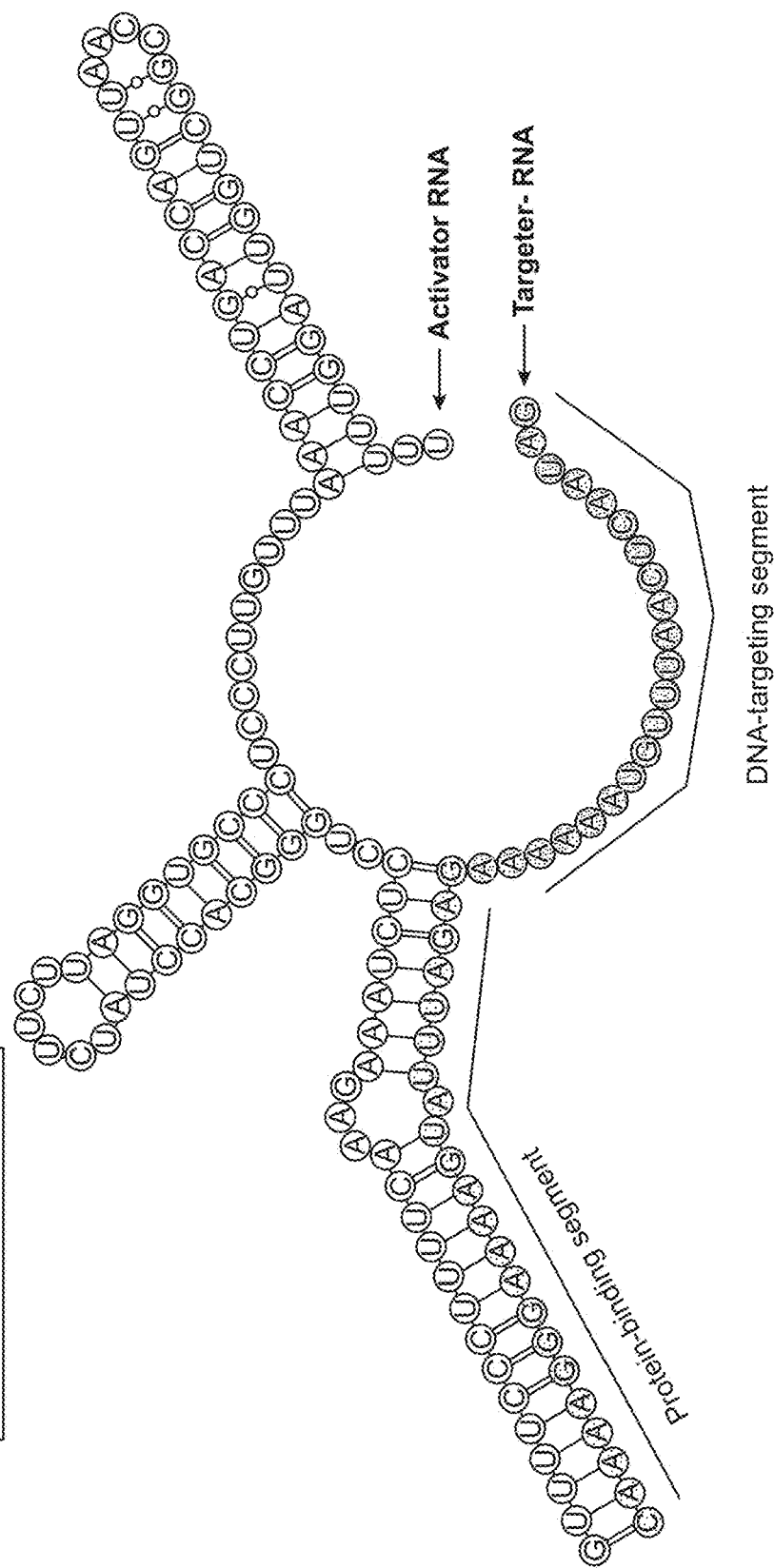
Figure 57A:
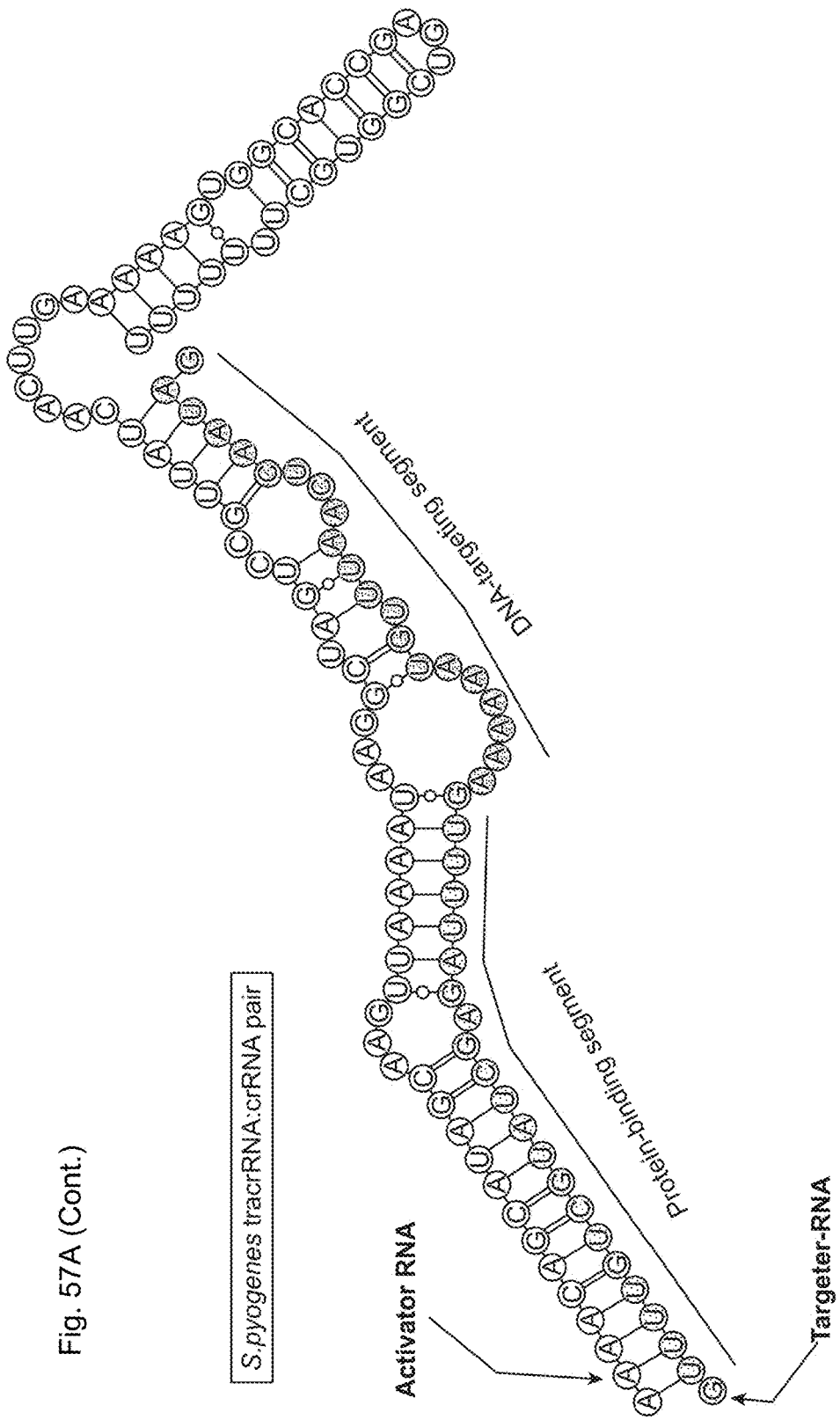
Figure 57B:
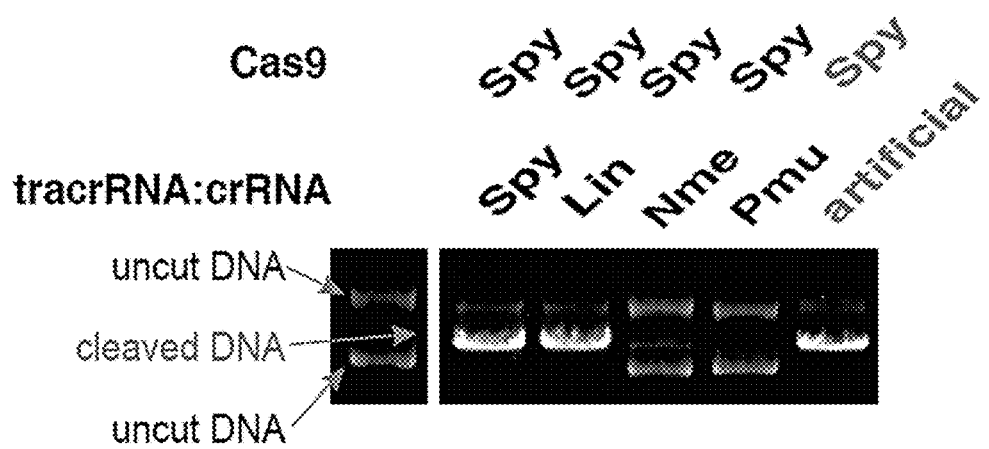

FIG. 57A-57B demonstrate that artificial sequences that share roughly 50% identity with naturally occurring a tracrRNAs and crRNAs can function with Cas9 to cleave target DNA as long as the structure of the protein-binding domain of the DNA-targeting RNA is conserved.

DEFINITIONS—Part I

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. "Oligonucleotide" generally refers to polynucleotides of between about 5 and about 100 nucleotides of single- or double-stranded DNA. However, for the purposes of this disclosure, there is no upper limit to the length of an oligonucleotide. Oligonucleotides are also known as "oligomers" or "oligos" and may be isolated from genes, or chemically synthesized by methods known in the art. The terms "polynucleotide" and "nucleic acid" should be understood to include, as applicable to the embodiments being described, single-stranded (such as sense or antisense) and double-stranded polynucleotides.

A "stem-loop structure" refers to a nucleic acid having a secondary structure that includes a region of nucleotides which are known or predicted to form a double strand (step portion) that is linked on one side by a region of predominantly single-stranded nucleotides (loop portion). The terms "hairpin" and "fold-back" structures are also used herein to refer to stem-loop structures. Such structures are well known in the art and these terms are used consistently with their known meanings in the art. As is known in the art, a stem-loop structure does not require exact base-pairing. Thus, the stem may include one or more base mismatches. Alternatively, the base-pairing may be exact, i.e. not include any mismatches.

By "hybridizable" or "complementary" or "substantially complementary" it is meant that a nucleic acid (e.g. RNA) comprises a sequence of nucleotides that enables it to non-covalently bind, i.e. form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. As is known in the art, standard Watson-Crick base-pairing includes: adenine (A) pairing with thymidine (T), adenine (A) pairing with uracil (U), and guanine (G) pairing with cytosine (C) [DNA, RNA]. In addition, it is also known in the art that for hybridization between two RNA molecules (e.g., dsRNA), guanine (G) base pairs with uracil (U). For example, G/U base-pairing is partially responsible for the degeneracy (i.e., redundancy) of the genetic code in the context of tRNA anti-codon base-pairing with codons in mRNA. In the context of this disclosure, a guanine (G) of a protein-binding segment (dsRNA duplex) of a subject DNA-targeting RNA molecule is considered complementary to a uracil (U), and vice versa. As such, when a G/U base-pair can be made at a given nucleotide position a protein-binding segment (dsRNA duplex) of a subject DNA-targeting RNA molecule, the position is not considered to be non-complementary, but is instead considered to be complementary.

Hybridization and washing conditions are well known and exemplified in Sambrook, J., Fritsch, E. F. and Maniatis, T. Molecular Cloning: A Laboratory Manual, Second Edition, Cold Spring Harbor Laboratory Press, Cold Spring Harbor (1989), particularly Chapter 11 and Table 11.1 therein; and Sambrook, J. and Russell, W., Molecular Cloning: A Laboratory Manual, Third Edition, Cold Spring Harbor Laboratory Press, Cold Spring Harbor (2001). The conditions of temperature and ionic strength determine the "stringency" of the hybridization.

Hybridization requires that the two nucleic acids contain complementary sequences, although mismatches between bases are possible. The conditions appropriate for hybridization between two nucleic acids depend on the length of the nucleic acids and the degree of complementation, variables well known in the art. The greater the degree of complementation between two nucleotide sequences, the greater the value of the melting temperature (Tm) for hybrids of nucleic acids having those sequences. For hybridizations between nucleic acids with short stretches of complementarity (e.g. complementarity over 35 or less, 30 or less, 25 or less, 22 or less, 20 or less, or 18 or less nucleotides) the position of mismatches becomes important (see Sambrook et al., supra, 11.7-11.8). Typically, the length for a hybridizable nucleic acid is at least about 10 nucleotides. Illustrative minimum lengths for a hybridizable nucleic acid are: at least about 15 nucleotides; at least about 20 nucleotides; at least about 22 nucleotides; at least about 25 nucleotides; and at least about 30 nucleotides). Furthermore, the skilled artisan will recognize that the temperature and wash solution salt concentration may be adjusted as necessary according to factors such as length of the region of complementation and the degree of complementation.

It is understood in the art that the sequence of polynucleotide need not be 100% complementary to that of its target nucleic acid to be specifically hybridizable or hybridizable. Moreover, a polynucleotide may hybridize over one or more segments such that intervening or adjacent segments are not involved in the hybridization event (e.g., a loop structure or hairpin structure). A polynucleotide can comprise at least 70%, at least 80%, at least 90%, at least 95%, at least 99%, or 100% sequence complementarity to a target region within the target nucleic acid sequence to which they are targeted. For example, an antisense nucleic acid in which 18 of 20 nucleotides of the antisense compound are complementary to a target region, and would therefore specifically hybridize, would represent 90 percent complementarity. In this example, the remaining noncomplementary nucleotides may be clustered or interspersed with complementary nucleotides and need not be contiguous to each other or to complementary nucleotides. Percent complementarity between particular stretches of nucleic acid sequences within nucleic acids can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489).

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones.

"Binding" as used herein (e.g. with reference to an RNA-binding domain of a polypeptide) refers to a non-covalent interaction between macromolecules (e.g., between a protein and a nucleic acid). While in a state of non-covalent interaction, the macromolecules are said to be "associated" or "interacting" or "binding" (e.g., when a molecule X is said to interact with a molecule Y, it is meant the molecule X binds to molecule Y in a non-covalent manner). Not all components of a binding interaction need be sequence-specific (e.g., contacts with phosphate residues in a DNA backbone), but some portions of a binding interaction may be sequence-specific. Binding interactions are generally characterized by a dissociation constant (Kd) of less than $10^{-6}$ M, less than $10^{-7}$ M, less than $10^{-8}$ M, less than $10^{-9}$ M, less than $10^{-10}$ M, less than $10^{-11}$ M, less than $10^{-12}$ M, less than $10^{-13}$ M, less than $10^{-14}$ M, or less than $10^{-15}$ M. "Affinity" refers to the strength of binding, increased binding affinity being correlated with a lower Kd.

By "binding domain" it is meant a protein domain that is able to bind non-covalently to another molecule. A binding domain can bind to, for example, a DNA molecule (a DNA-binding protein), an RNA molecule (an RNA-binding protein) and/or a protein molecule (a protein-binding protein). In the case of a protein domain-binding protein, it can bind to itself (to form homodimers, homotrimers, etc.) and/or it can bind to one or more molecules of a different protein or proteins.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide containing side chains consisting of asparagine and glutamine; a group of amino acids having aromatic side chains consists of phenylalanine, tyrosine, and tryptophan; a group of amino acids having basic side chains consists of lysine, arginine, and histidine; a group of amino acids having acidic side chains consists of glutamate and aspartate; and a group of amino acids having sulfur containing side chains consists of cysteine and methionine. Exemplary conservative amino acid substitution groups are: valine-leucine-isoleucine, phenylalanine-tyrosine, lysine-arginine, alanine-valine, and asparagine-glutamine.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence identity can be determined in a number of different manners. To determine sequence identity, sequences can be aligned using various methods and computer programs (e.g., BLAST, T-COFFEE, MUSCLE, MAFFT, etc.), available over the world wide web at sites including ncbi.nlm.nili.gov/BLAST, ebi.ac.uk/Tools/msa/tcoffee/, ebi.ac.uk/Tools/msa/muscle/, mafft.cbrc.jp/alignment/software/. See, e.g., Altschul et al. (1990), J. Mol. Bioi. 215:403-10.

A DNA sequence that "encodes" a particular RNA is a DNA nucleic acid sequence that is transcribed into RNA. A DNA polynucleotide may encode an RNA (mRNA) that is translated into protein, or a DNA polynucleotide may encode an RNA that is not translated into protein (e.g. tRNA, rRNA, or a DNA-targeting RNA; also called "non-coding" RNA or "ncRNA").

A "protein coding sequence" or a sequence that encodes a particular protein or polypeptide, is a nucleic acid sequence that is transcribed into mRNA (in the case of DNA) and is translated (in the case of mRNA) into a polypeptide in vitro or in vivo when placed under the control of appropriate regulatory sequences. The boundaries of the coding sequence are determined by a start codon at the 5' terminus (N-terminus) and a translation stop nonsense codon at the 3' terminus (C-terminus). A coding sequence can include, but is not limited to, cDNA from prokaryotic or eukaryotic mRNA, genomic DNA sequences from prokaryotic or eukaryotic DNA, and synthetic nucleic acids. A transcription termination sequence will usually be located 3' to the coding sequence.

As used herein, a "promoter sequence" is a DNA regulatory region capable of binding RNA polymerase and initiating transcription of a downstream (3' direction) coding or non-coding sequence. For purposes of defining the present invention, the promoter sequence is bounded at its 3' terminus by the transcription initiation site and extends upstream (5' direction) to include the minimum number of bases or elements necessary to initiate transcription at levels detectable above background. Within the promoter sequence will be found a transcription initiation site, as well as protein binding domains responsible for the binding of RNA polymerase. Eukaryotic promoters will often, but not always, contain "TATA" boxes and "CAT" boxes. Various promoters, including inducible promoters, may be used to drive the various vectors of the present invention.

A promoter can be a constitutively active promoter (i.e., a promoter that is constitutively in an active/"ON" state), it may be an inducible promoter (i.e., a promoter whose state, active/"ON" or inactive/"OFF", is controlled by an external stimulus, e.g., the presence of a particular temperature, compound, or protein.), it may be a spatially restricted promoter (i.e., transcriptional control element, enhancer, etc.)(e.g., tissue specific promoter, cell type specific promoter, etc.), and it may be a temporally restricted promoter (i.e., the promoter is in the "ON" state or "OFF" state during specific stages of embryonic development or during specific stages of a biological process, e.g., hair follicle cycle in mice).

Suitable promoters can be derived from viruses and can therefore be referred to as viral promoters, or they can be derived from any organism, including prokaryotic or eukaryotic organisms. Suitable promoters can be used to drive expression by any RNA polymerase (e.g., pol I, pol II, pol III). Exemplary promoters include, but are not limited to the SV40 early promoter, mouse mammary tumor virus long terminal repeat (LTR) promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, a human U6 small nuclear promoter (U6) (Miyagishi et al., Nature Biotechnology 20, 497-500 (2002)), an enhanced U6 promoter (e.g., Xia et al., Nucleic Acids Res. 2003 Sep. 1; 31(17)), a human H1 promoter (H1), and the like.

Examples of inducible promoters include, but are not limited to T7 RNA polymerase promoter, T3 RNA polymerase promoter, Isopropyl-beta-D-thiogalactopyranoside (IPTG)-regulated promoter, lactose induced promoter, heat shock promoter, Tetracycline-regulated promoter, Steroid-regulated promoter, Metal-regulated promoter, estrogen receptor-regulated promoter, etc. Inducible promoters can therefore be regulated by molecules including, but not limited to, doxycycline; RNA polymerase, e.g., T7 RNA polymerase; an estrogen receptor; an estrogen receptor fusion; etc.

In some embodiments, the promoter is a spatially restricted promoter (i.e., cell type specific promoter, tissue specific promoter, etc.) such that in a multi-cellular organism, the promoter is active (i.e., "ON") in a subset of specific cells. Spatially restricted promoters may also be referred to as enhancers, transcriptional control elements, control sequences, etc. Any convenient spatially restricted promoter may be used and the choice of suitable promoter (e.g., a brain specific promoter, a promoter that drives expression in a subset of neurons, a promoter that drives expression in the germline, a promoter that drives expression in the lungs, a promoter that drives expression in muscles, a promoter that drives expression in islet cells of the pancreas, etc.) will depend on the organism. For example, various spatially restricted promoters are known for plants, flies, worms, mammals, mice, etc. Thus, a spatially restricted promoter can be used to regulate the expression of a nucleic acid encoding a subject site-directed modifying polypeptide in a wide variety of different tissues and cell types, depending on the organism. Some spatially restricted promoters are also temporally restricted such that the promoter is in the "ON" state or "OFF" state during specific stages of embryonic development or during specific stages of a biological process (e.g., hair follicle cycle in mice).

For illustration purposes, examples of spatially restricted promoters include, but are not limited to, neuron-specific promoters, adipocyte-specific promoters, cardiomyocyte-specific promoters, smooth muscle-specific promoters, photoreceptor-specific promoters, etc. Neuron-specific spatially restricted promoters include, but are not limited to, a neuron-specific enolase (NSE) promoter (see, e.g., EMBL HSENO2, X51956); an aromatic amino acid decarboxylase (AADC) promoter; a neurofilament promoter (see, e.g., GenBank HUMNFL, L04147); a synapsin promoter (see, e.g., GenBank HUMSYNIB, M55301); a thy-1 promoter (see, e.g., Chen et al. (1987) Cell 51:7-19; and Llewellyn, et al. (2010) Nat. Med. 16(10):1161-1166); a serotonin receptor promoter (see, e.g., GenBank S62283); a tyrosine hydroxylase promoter (TH) (see, e.g., Oh et al. (2009) Gene Ther 16:437; Sasaoka et al. (1992) Mol. Brain Res. 16:274; Boundy et al. (1998) J. Neurosci. 18:9989; and Kaneda et al. (1991) Neuron 6:583-594); a GnRH promoter (see, e.g., Radovick et al. (1991) Proc. Natl. Acad. Sci. USA 88:3402-3406); an L7 promoter (see, e.g., Oberdick et al. (1990) Science 248:223-226); a DNMT promoter (see, e.g., Bartge et al. (1988) Proc. Natl. Acad. Sci. USA 85:3648-3652); an enkephalin promoter (see, e.g., Comb et al. (1988) EMBO J. 17:3793-3805); a myelin basic protein (MBP) promoter; a Ca2+-calmodulin-dependent protein kinase II-alpha (CamKIIα) promoter (see, e.g., Mayford et al. (1996) Proc. Natl. Acad. Sci. USA 93:13250; and Casanova et al. (2001) Genesis 31:37); a CMV enhancer/platelet-derived growth factor-β promoter (see, e.g., Liu et al. (2004) Gene Therapy 11:52-60); and the like.

Adipocyte-specific spatially restricted promoters include, but are not limited to aP2 gene promoter/enhancer, e.g., a region from −5.4 kb to +21 bp of a human aP2 gene (see, e.g., Tozzo et al. (1997) Endocrinol. 138:1604; Ross et al. (1990) Proc. Natl. Acad. Sci. USA 87:9590; and Pavjani et al. (2005) Nat. Med. 11:797); a glucose transporter-4 (GLUT4) promoter (see, e.g., Knight et al. (2003) Proc. Natl. Acad. Sci. USA 100:14725); a fatty acid translocase (FAT/CD36) promoter (see, e.g., Kuriki et al. (2002) Biol. Pharm. Bull. 25:1476; and Sato et al. (2002) J. Biol. Chem. 277:15703); a stearoyl-CoA desaturase-1 (SCD1) promoter (Tabor et al. (1999) J. Biol. Chem. 274:20603); a leptin promoter (see, e.g., Mason et al. (1998) Endocrinol. 139: 1013; and Chen et al. (1999) Biochem. Biophys. Res. Comm 262:187); an adiponectin promoter (see, e.g., Kita et al. (2005) Biochem. Biophys. Res. Comm 331:484; and Chakrabarti (2010) Endocrinol. 151:2408); an adipsin promoter (see, e.g., Platt et al. (1989) Proc. Natl. Acad. Sci. USA 86:7490); a resistin promoter (see, e.g., Seo et al. (2003) Molec. Endocrinol. 17:1522); and the like.

Cardiomyocyte-specific spatially restricted promoters include, but are not limited to control sequences derived from the following genes: myosin light chain-2, α-myosin heavy chain, AE3, cardiac troponin C, cardiac actin, and the like. Franz et al. (1997) Cardiovasc. Res. 35:560-566; Robbins et al. (1995) Ann. N.Y. Acad. Sci. 752:492-505; Linn et al. (1995) Circ. Res. 76:584-591; Parmacek et al. (1994) Mol. Cell. Biol. 14:1870-1885; Hunter et al. (1993) Hypertension 22:608-617; and Sartorelli et al. (1992) Proc. Natl. Acad. Sci. USA 89:4047-4051.

Smooth muscle-specific spatially restricted promoters include, but are not limited to an SM22α promoter (see, e.g., Akyürek et al. (2000) Mol. Med. 6:983; and U.S. Pat. No. 7,169,874); a smoothelin promoter (see, e.g., WO 2001/018048); an α-smooth muscle actin promoter; and the like. For example, a 0.4 kb region of the SM22α promoter, within which lie two CArG elements, has been shown to mediate vascular smooth muscle cell-specific expression (see, e.g., Kim, et al. (1997) Mol. Cell. Biol. 17, 2266-2278; Li, et al., (1996) J. Cell Biol. 132, 849-859; and Moessler, et al. (1996) Development 122, 2415-2425).

Photoreceptor-specific spatially restricted promoters include, but are not limited to, a rhodopsin promoter; a rhodopsin kinase promoter (Young et al. (2003) Ophthalmol. Vis. Sci. 44:4076); a beta phosphodiesterase gene promoter (Nicoud et al. (2007) J. Gene Med. 9:1015); a retinitis pigmentosa gene promoter (Nicoud et al. (2007) supra); an interphotoreceptor retinoid-binding protein (IRBP) gene enhancer (Nicoud et al. (2007) supra); an IRBP gene promoter (Yokoyama et al. (1992) Exp Eye Res. 55:225); and the like.

The terms "DNA regulatory sequences," "control elements," and "regulatory elements," used interchangeably herein, refer to transcriptional and translational control sequences, such as promoters, enhancers, polyadenylation signals, terminators, protein degradation signals, and the like, that provide for and/or regulate transcription of a non-coding sequence (e.g., DNA-targeting RNA) or a coding sequence (e.g., site-directed modifying polypeptide, or Cas9/Csn1 polypeptide) and/or regulate translation of an encoded polypeptide.

The term "naturally-occurring" or "unmodified" as used herein as applied to a nucleic acid, a polypeptide, a cell, or an organism, refers to a nucleic acid, polypeptide, cell, or organism that is found in nature. For example, a polypeptide or polynucleotide sequence that is present in an organism (including viruses) that can be isolated from a source in nature and which has not been intentionally modified by a human in the laboratory is naturally occurring.

The term "chimeric" as used herein as applied to a nucleic acid or polypeptide refers to two components that are defined by structures derived from different sources. For example, where "chimeric" is used in the context of a chimeric polypeptide (e.g., a chimeric Cas9/Csn1 protein), the chimeric polypeptide includes amino acid sequences that are derived from different polypeptides. A chimeric polypeptide may comprise either modified or naturally-occurring polypeptide sequences (e.g., a first amino acid sequence from a modified or unmodified Cas9/Csn1 protein; and a second amino acid sequence other than the Cas9/Csn1 protein). Similarly, "chimeric" in the context of a polynucleotide encoding a chimeric polypeptide includes nucleotide sequences derived from different coding regions (e.g., a first nucleotide sequence encoding a modified or unmodified Cas9/Csn1 protein; and a second nucleotide sequence encoding a polypeptide other than a Cas9/Csn1 protein).

The term "chimeric polypeptide" refers to a polypeptide which is made by the combination (i.e., "fusion") of two otherwise separated segments of amino sequence, usually through human intervention. A polypeptide that comprises a chimeric amino acid sequence is a chimeric polypeptide. Some chimeric polypeptides can be referred to as "fusion variants."

"Heterologous," as used herein, means a nucleotide or polypeptide sequence that is not found in the native nucleic acid or protein, respectively. For example, in a chimeric Cas9/Csn1 protein, the RNA-binding domain of a naturally-occurring bacterial Cas9/Csn1 polypeptide (or a variant thereof) may be fused to a heterologous polypeptide sequence (i.e. a polypeptide sequence from a protein other than Cas9/Csn1 or a polypeptide sequence from another organism). The heterologous polypeptide sequence may exhibit an activity (e.g., enzymatic activity) that will also be exhibited by the chimeric Cas9/Csn1 protein (e.g., methyltransferase activity, acetyltransferase activity, kinase activity, ubiquitinating activity, etc.). A heterologous nucleic acid sequence may be linked to a naturally-occurring nucleic acid sequence (or a variant thereof) (e.g., by genetic engineering) to generate a chimeric nucleotide sequence encoding a chimeric polypeptide. As another example, in a fusion variant Cas9 site-directed polypeptide, a variant Cas9 site-directed polypeptide may be fused to a heterologous polypeptide (i.e. a polypeptide other than Cas9), which exhibits an activity that will also be exhibited by the fusion variant Cas9 site-directed polypeptide. A heterologous nucleic acid sequence may be linked to a variant Cas9 site-directed polypeptide (e.g., by genetic engineering) to generate a nucleotide sequence encoding a fusion variant Cas9 site-directed polypeptide.

"Recombinant" as used herein, means that a particular nucleic acid (DNA or RNA) is the product of various combinations of cloning, restriction, polymerase chain reaction (PCR) and/or ligation steps resulting in a construct having a structural coding or non-coding sequence distinguishable from endogenous nucleic acids found in natural systems. DNA sequences encoding polypeptides can be assembled from cDNA fragments or from a series of synthetic oligonucleotides, to provide a synthetic nucleic acid which is capable of being expressed from a recombinant transcriptional unit contained in a cell or in a cell-free transcription and translation system. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "DNA regulatory sequences", below). Alternatively, DNA sequences encoding RNA (e.g., DNA-targeting RNA) that is not translated may also be considered recombinant. Thus, e.g., the term "recombinant" nucleic acid refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a codon encoding the same amino acid, a conservative amino acid, or a non-conservative amino acid. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques. When a recombinant polynucleotide encodes a polypeptide, the sequence of the encoded polypeptide can be naturally occurring ("wild type") or can be a variant (e.g., a mutant) of the naturally occurring sequence. Thus, the term "recombinant" polypeptide does not necessarily refer to a polypeptide whose sequence does not naturally occur. Instead, a "recombinant" polypeptide is encoded by a recombinant DNA sequence, but the sequence of the polypeptide can be naturally occurring ("wild type") or non-naturally occurring (e.g., a variant, a mutant, etc.). Thus, a "recombinant" polypeptide is the result of human intervention, but may be a naturally occurring amino acid sequence.

A "vector" or "expression vector" is a replicon, such as plasmid, phage, virus, or cosmid, to which another DNA segment, i.e. an "insert", may be attached so as to bring about the replication of the attached segment in a cell.

An "expression cassette" comprises a DNA coding sequence operably linked to a promoter. "Operably linked" refers to a juxtaposition wherein the components so described are in a relationship permitting them to function in their intended manner. For instance, a promoter is operably linked to a coding sequence if the promoter affects its transcription or expression.

The terms "recombinant expression vector," or "DNA construct" are used interchangeably herein to refer to a DNA molecule comprising a vector and at least one insert. Recombinant expression vectors are usually generated for the purpose of expressing and/or propagating the insert(s), or for the construction of other recombinant nucleotide sequences. The insert(s) may or may not be operably linked to a promoter sequence and may or may not be operably linked to DNA regulatory sequences.

A cell has been "genetically modified" or "transformed" or "transfected" by exogenous DNA, e.g. a recombinant expression vector, when such DNA has been introduced inside the cell. The presence of the exogenous DNA results in permanent or transient genetic change. The transforming DNA may or may not be integrated (covalently linked) into the genome of the cell. In prokaryotes, yeast, and mammalian cells for example, the transforming DNA may be maintained on an episomal element such as a plasmid. With respect to eukaryotic cells, a stably transformed cell is one in which the transforming DNA has become integrated into a chromosome so that it is inherited by daughter cells through chromosome replication. This stability is demonstrated by the ability of the eukaryotic cell to establish cell lines or clones that comprise a population of daughter cells containing the transforming DNA. A "clone" is a population of cells derived from a single cell or common ancestor by mitosis. A "cell line" is a clone of a primary cell that is capable of stable growth in vitro for many generations.

Suitable methods of genetic modification (also referred to as "transformation") include e.g., viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et., al Adv Drug Deliv Rev. 2012 Sep. 13. pii: S0169-409X(12)00283-9.doi:10.1016/j.addr.2012.09.023), and the like.

The choice of method of genetic modification is generally dependent on the type of cell being transformed and the circumstances under which the transformation is taking place (e.g., in vitro, ex vivo, or in vivo). A general discussion of these methods can be found in Ausubel, et al., Short Protocols in Molecular Biology, 3rd ed., Wiley & Sons, 1995.

A "target DNA" as used herein is a DNA polynucleotide that comprises a "target site" or "target sequence." The terms "target site" or "target sequence" or "target protospacer DNA" are used interchangeably herein to refer to a nucleic acid sequence present in a target DNA to which a DNA-targeting segment of a subject DNA-targeting RNA will bind (see FIGS. 1A-1B and FIG. 39A-39B), provided sufficient conditions for binding exist. For example, the target site (or target sequence) 5'-GAGCATATC-3' within a target DNA is targeted by (or is bound by, or hybridizes with, or is complementary to) the RNA sequence 5'-GAUAUGCUC-3'. Suitable DNA/RNA binding conditions include physiological conditions normally present in a cell. Other suitable DNA/RNA binding conditions (e.g., conditions in a cell-free system) are known in the art; see, e.g., Sambrook, supra. The strand of the target DNA that is complementary to and hybridizes with the DNA-targeting RNA is referred to as the "complementary strand" and the strand of the target DNA that is complementary to the "complementary strand" (and is therefore not complementary to the DNA-targeting RNA) is referred to as the "noncomplementary strand" or "non-complementary strand" (see FIG. 12A-12E).

By "site-directed modifying polypeptide" or "RNA-binding site-directed polypeptide" or "RNA-binding site-directed modifying polypeptide" or "site-directed polypeptide" it is meant a polypeptide that binds RNA and is targeted to a specific DNA sequence. A site-directed modifying polypeptide as described herein is targeted to a specific DNA sequence by the RNA molecule to which it is bound. The RNA molecule comprises a sequence that is complementary to a target sequence within the target DNA, thus targeting the bound polypeptide to a specific location within the target DNA (the target sequence).

By "cleavage" it is meant the breakage of the covalent backbone of a DNA molecule. Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. DNA cleavage can result in the production of either blunt ends or staggered ends. In certain embodiments, a complex comprising a DNA-targeting RNA and a site-directed modifying polypeptide is used for targeted double-stranded DNA cleavage.

"Nuclease" and "endonuclease" are used interchangeably herein to mean an enzyme which possesses catalytic activity for DNA cleavage.

By "cleavage domain" or "active domain" or "nuclease domain" of a nuclease it is meant the polypeptide sequence or domain within the nuclease which possesses the catalytic activity for DNA cleavage. A cleavage domain can be contained in a single polypeptide chain or cleavage activity can result from the association of two (or more) polypeptides. A single nuclease domain may consist of more than one isolated stretch of amino acids within a given polypeptide.

The RNA molecule that binds to the site-directed modifying polypeptide and targets the polypeptide to a specific location within the target DNA is referred to herein as the "DNA-targeting RNA" or "DNA-targeting RNA polynucleotide" (also referred to herein as a "guide RNA" or "gRNA"). A subject DNA-targeting RNA comprises two segments, a "DNA-targeting segment" and a "protein-binding segment." By "segment" it is meant a segment/section/region of a molecule, e.g., a contiguous stretch of nucleotides in an RNA. A segment can also mean a region/section of a complex such that a segment may comprise regions of more than one molecule. For example, in some cases the protein-binding segment (described below) of a DNA-targeting RNA is one RNA molecule and the protein-binding segment therefore comprises a region of that RNA molecule. In other cases, the protein-binding segment (described below) of a DNA-targeting RNA comprises two separate molecules that are hybridized along a region of complementarity. As an illustrative, non-limiting example, a protein-binding segment of a DNA-targeting RNA that comprises two separate molecules can comprise (i) base pairs 40-75 of a first RNA molecule that is 100 base pairs in length; and (ii) base pairs 10-25 of a second RNA molecule that is 50 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and may include regions of RNA molecules that are of any total length and may or may not include regions with complementarity to other molecules.

The DNA-targeting segment (or "DNA-targeting sequence") comprises a nucleotide sequence that is complementary to a specific sequence within a target DNA (the complementary strand of the target DNA). The protein-binding segment (or "protein-binding sequence") interacts with a site-directed modifying polypeptide. When the site-directed modifying polypeptide is a Cas9 or Cas9 related polypeptide (described in more detail below), site-specific cleavage of the target DNA occurs at locations determined by both (i) base-pairing complementarity between the DNA-targeting RNA and the target DNA; and (ii) a short motif (referred to as the protospacer adjacent motif (PAM)) in the target DNA.

The protein-binding segment of a subject DNA-targeting RNA comprises two complementary stretches of nucleotides that hybridize to one another to form a double stranded RNA duplex (dsRNA duplex).

In some embodiments, a subject nucleic acid (e.g., a DNA-targeting RNA, a nucleic acid comprising a nucleotide sequence encoding a DNA-targeting RNA; a nucleic acid encoding a site-directed polypeptide; etc.) comprises a modification or sequence that provides for an additional desirable feature (e.g., modified or regulated stability; subcellular targeting; tracking, e.g., a fluorescent label; a binding site for a protein or protein complex; etc.). Non-limiting examples include: a 5' cap (e.g., a 7-methylguanylate cap (m7G)); a 3' polyadenylated tail (i.e., a 3' poly(A) tail); a riboswitch sequence (e.g., to allow for regulated stability and/or regulated accessibility by proteins and/or protein complexes); a stability control sequence; a sequence that forms a dsRNA duplex (i.e., a hairpin)); a modification or sequence that targets the RNA to a subcellular location (e.g., nucleus, mitochondria, chloroplasts, and the like); a modification or sequence that provides for tracking (e.g., direct conjugation to a fluorescent molecule, conjugation to a moiety that facilitates fluorescent detection, a sequence that allows for fluorescent detection, etc.); a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like); and combinations thereof.

In some embodiments, a DNA-targeting RNA comprises an additional segment at either the 5' or 3' end that provides for any of the features described above. For example, a suitable third segment can comprise a 5' cap (e.g., a 7-methylguanylate cap (m7G)); a 3' polyadenylated tail (i.e., a 3' poly(A) tail); a riboswitch sequence (e.g., to allow for regulated stability and/or regulated accessibility by proteins and protein complexes); a stability control sequence; a sequence that forms a dsRNA duplex (i.e., a hairpin)); a sequence that targets the RNA to a subcellular location (e.g., nucleus, mitochondria, chloroplasts, and the like); a modification or sequence that provides for tracking (e.g., direct conjugation to a fluorescent molecule, conjugation to a moiety that facilitates fluorescent detection, a sequence that allows for fluorescent detection, etc.); a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like); and combinations thereof.

A subject DNA-targeting RNA and a subject site-directed modifying polypeptide (i.e., site-directed polypeptide) form a complex (i.e., bind via non-covalent interactions). The DNA-targeting RNA provides target specificity to the complex by comprising a nucleotide sequence that is complementary to a sequence of a target DNA. The site-directed modifying polypeptide of the complex provides the site-specific activity. In other words, the site-directed modifying polypeptide is guided to a target DNA sequence (e.g. a target sequence in a chromosomal nucleic acid; a target sequence in an extrachromosomal nucleic acid, e.g. an episomal nucleic acid, a minicircle, etc.; a target sequence in a mitochondrial nucleic acid; a target sequence in a chloroplast nucleic acid; a target sequence in a plasmid; etc.) by virtue of its association with the protein-binding segment of the DNA-targeting RNA.

In some embodiments, a subject DNA-targeting RNA comprises two separate RNA molecules (RNA polynucleotides: an "activator-RNA" and a "targeter-RNA", see below) and is referred to herein as a "double-molecule DNA-targeting RNA" or a "two-molecule DNA-targeting RNA." In other embodiments, the subject DNA-targeting RNA is a single RNA molecule (single RNA polynucleotide) and is referred to herein as a "single-molecule DNA-targeting RNA," a "single-guide RNA," or an "sgRNA." The term "DNA-targeting RNA" or "gRNA" is inclusive, referring both to double-molecule DNA-targeting RNAs and to single-molecule DNA-targeting RNAs (i.e., sgRNAs).

An exemplary two-molecule DNA-targeting RNA comprises a crRNA-like ("CRISPR RNA" or "targeter-RNA" or "crRNA" or "crRNA repeat") molecule and a corresponding tracrRNA-like ("trans-acting CRISPR RNA" or "activator-RNA" or "tracrRNA") molecule. A crRNA-like molecule (targeter-RNA) comprises both the DNA-targeting segment (single stranded) of the DNA-targeting RNA and a stretch ("duplex-forming segment") of nucleotides that forms one half of the dsRNA duplex of the protein-binding segment of the DNA-targeting RNA. A corresponding tracrRNA-like molecule (activator-RNA) comprises a stretch of nucleotides (duplex-forming segment) that forms the other half of the dsRNA duplex of the protein-binding segment of the DNA-targeting RNA. In other words, a stretch of nucleotides of a crRNA-like molecule are complementary to and hybridize with a stretch of nucleotides of a tracrRNA-like molecule to form the dsRNA duplex of the protein-binding domain of the DNA-targeting RNA. As such, each crRNA-like molecule can be said to have a corresponding tracrRNA-like molecule. The crRNA-like molecule additionally provides the single stranded DNA-targeting segment. Thus, a crRNA-like and a tracrRNA-like molecule (as a corresponding pair) hybridize to form a DNA-targeting RNA. The exact sequence of a given crRNA or tracrRNA molecule is characteristic of the species in which the RNA molecules are found. Various crRNAs and tracrRNAs are depicted in corresponding complementary pairs in FIG. 8. A subject double-molecule DNA-targeting RNA can comprise any corresponding crRNA and tracrRNA pair. A subject double-molecule DNA-targeting RNA can comprise any corresponding crRNA and tracrRNA pair.

The term "activator-RNA" is used herein to mean a tracrRNA-like molecule of a double-molecule DNA-targeting RNA. The term "targeter-RNA" is used herein to mean a crRNA-like molecule of a double-molecule DNA-targeting RNA. The term "duplex-forming segment" is used herein to mean the stretch of nucleotides of an activator-RNA or a targeter-RNA that contributes to the formation of the dsRNA duplex by hybridizing to a stretch of nucleotides of a corresponding activator-RNA or targeter-RNA molecule. In other words, an activator-RNA comprises a duplex-forming segment that is complementary to the duplex-forming segment of the corresponding targeter-RNA. As such, an activator-RNA comprises a duplex-forming segment while a targeter-RNA comprises both a duplex-forming segment and the DNA-targeting segment of the DNA-targeting RNA. Therefore, a subject double-molecule DNA-targeting RNA can be comprised of any corresponding activator-RNA and targeter-RNA pair.

A "host cell," as used herein, denotes an in vivo or in vitro eukaryotic cell, a prokaryotic cell (e.g., bacterial or archaeal cell), or a cell from a multicellular organism (e.g., a cell line) cultured as a unicellular entity, which eukaryotic or prokaryotic cells can be, or have been, used as recipients for a nucleic acid, and include the progeny of the original cell which has been transformed by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector. For example, a subject bacterial host cell is a genetically modified bacterial host cell by virtue of introduction into a suitable bacterial host cell of an exogenous nucleic acid (e.g., a plasmid or recombinant expression vector) and a subject eukaryotic host cell is a genetically modified eukaryotic host cell (e.g., a mammalian germ cell), by virtue of introduction into a suitable eukaryotic host cell of an exogenous nucleic acid.

The term "stem cell" is used herein to refer to a cell (e.g., plant stem cell, vertebrate stem cell) that has the ability both to self-renew and to generate a differentiated cell type (see Morrison et al. (1997) Cell 88:287-298). In the context of cell ontogeny, the adjective "differentiated", or "differentiating" is a relative term. A "differentiated cell" is a cell that has progressed further down the developmental pathway than the cell it is being compared with. Thus, pluripotent stem cells (described below) can differentiate into lineage-restricted progenitor cells (e.g., mesodermal stem cells), which in turn can differentiate into cells that are further restricted (e.g., neuron progenitors), which can differentiate into end-stage cells (i.e., terminally differentiated cells, e.g., neurons, cardiomyocytes, etc.), which play a characteristic role in a certain tissue type, and may or may not retain the capacity to proliferate further. Stem cells may be characterized by both the presence of specific markers (e.g., proteins, RNAs, etc.) and the absence of specific markers. Stem cells may also be identified by functional assays both in vitro and in vivo, particularly assays relating to the ability of stem cells to give rise to multiple differentiated progeny.

Stem cells of interest include pluripotent stem cells (PSCs). The term "pluripotent stem cell" or "PSC" is used herein to mean a stem cell capable of producing all cell types of the organism. Therefore, a PSC can give rise to cells of all germ layers of the organism (e.g., the endoderm, mesoderm, and ectoderm of a vertebrate). Pluripotent cells are capable of forming teratomas and of contributing to ectoderm, mesoderm, or endoderm tissues in a living organism. Pluripotent stem cells of plants are capable of giving rise to all cell types of the plant (e.g., cells of the root, stem, leaves, etc.).

PSCs of animals can be derived in a number of different ways. For example, embryonic stem cells (ESCs) are derived from the inner cell mass of an embryo (Thomson et. al, Science. 1998 Nov. 6; 282(5391):1145-7) whereas induced pluripotent stem cells (iPSCs) are derived from somatic cells (Takahashi et. al, Cell. 2007 Nov. 30; 131(5): 861-72; Takahashi et. al, Nat Protoc. 2007; 2(12):3081-9; Yu et. al, Science. 2007 Dec. 21; 318(5858):1917-20. Epub 2007 Nov. 20). Because the term PSC refers to pluripotent stem cells regardless of their derivation, the term PSC encompasses the terms ESC and iPSC, as well as the term embryonic germ stem cells (EGSC), which are another example of a PSC. PSCs may be in the form of an established cell line, they may be obtained directly from primary embryonic tissue, or they may be derived from a somatic cell. PSCs can be target cells of the methods described herein.

By "embryonic stem cell" (ESC) is meant a PSC that was isolated from an embryo, typically from the inner cell mass of the blastocyst. ESC lines are listed in the NIH Human Embryonic Stem Cell Registry, e.g. hESBGN-01, hESBGN-02, hESBGN-03, hESBGN-04 (BresaGen, Inc.); HES-1, HES-2, HES-3, HES-4, HES-5, HES-6 (ES Cell International); Miz-hES1 (MizMedi Hospital-Seoul National University); HSF-1, HSF-6 (University of California at San Francisco); and H1, H7, H9, H13, H14 (Wisconsin Alumni Research Foundation (WiCell Research Institute)). Stem cells of interest also include embryonic stem cells from other primates, such as Rhesus stem cells and marmoset stem cells. The stem cells may be obtained from any mammalian species, e.g. human, equine, bovine, porcine, canine, feline, rodent, e.g. mice, rats, hamster, primate, etc. (Thomson et al. (1998) Science 282:1145; Thomson et al. (1995) Proc. Natl. Acad. Sci USA 92:7844; Thomson et al. (1996) Biol. Reprod. 55:254; Shamblott et al., Proc. Natl. Acad. Sci. USA 95:13726, 1998). In culture, ESCs typically grow as flat colonies with large nucleo-cytoplasmic ratios, defined borders and prominent nucleoli. In addition, ESCs express SSEA-3, SSEA-4, TRA-1-60, TRA-1-81, and Alkaline Phosphatase, but not SSEA-1. Examples of methods of generating and characterizing ESCs may be found in, for example, U.S. Pat. No. 7,029,913, U.S. Pat. No. 5,843,780, and U.S. Pat. No. 6,200,806, the disclosures of which are incorporated herein by reference. Methods for proliferating hESCs in the undifferentiated form are described in WO 99/20741, WO 01/51616, and WO 03/020920.

By "embryonic germ stem cell" (EGSC) or "embryonic germ cell" or "EG cell" is meant a PSC that is derived from germ cells and/or germ cell progenitors, e.g. primordial germ cells, i.e. those that would become sperm and eggs. Embryonic germ cells (EG cells) are thought to have properties similar to embryonic stem cells as described above. Examples of methods of generating and characterizing EG cells may be found in, for example, U.S. Pat. No. 7,153,684; Matsui, Y., et al., (1992) Cell 70:841; Shamblott, M., et al. (2001) Proc. Natl. Acad. Sci. USA 98: 113; Shamblott, M., et al. (1998) Proc. Natl. Acad. Sci. USA, 95:13726; and Koshimizu, U., et al. (1996) Development, 122:1235, the disclosures of which are incorporated herein by reference.

By "induced pluripotent stem cell" or "iPSC" it is meant a PSC that is derived from a cell that is not a PSC (i.e., from a cell this is differentiated relative to a PSC). iPSCs can be derived from multiple different cell types, including terminally differentiated cells. iPSCs have an ES cell-like morphology, growing as flat colonies with large nucleo-cytoplasmic ratios, defined borders and prominent nuclei. In addition, iPSCs express one or more key pluripotency markers known by one of ordinary skill in the art, including but not limited to Alkaline Phosphatase, SSEA3, SSEA4, Sox2, Oct3/4, Nanog, TRA160, TRA181, TDGF 1, Dnmt3b, FoxD3, GDF3, Cyp26a1, TERT, and zfp42. Examples of methods of generating and characterizing iPSCs may be found in, for example, U.S. Patent Publication Nos. US20090047263, US20090068742, US20090191159, US20090227032, US20090246875, and US20090304646, the disclosures of which are incorporated herein by reference. Generally, to generate iPSCs, somatic cells are provided with reprogramming factors (e.g. Oct4, SOX2, KLF4, MYC, Nanog, Lin28, etc.) known in the art to reprogram the somatic cells to become pluripotent stem cells.

By "somatic cell" it is meant any cell in an organism that, in the absence of experimental manipulation, does not ordinarily give rise to all types of cells in an organism. In other words, somatic cells are cells that have differentiated sufficiently that they will not naturally generate cells of all three germ layers of the body, i.e. ectoderm, mesoderm and endoderm. For example, somatic cells would include both neurons and neural progenitors, the latter of which may be able to naturally give rise to all or some cell types of the central nervous system but cannot give rise to cells of the mesoderm or endoderm lineages.

By "mitotic cell" it is meant a cell undergoing mitosis. Mitosis is the process by which a eukaryotic cell separates the chromosomes in its nucleus into two identical sets in two separate nuclei. It is generally followed immediately by cytokinesis, which divides the nuclei, cytoplasm, organelles and cell membrane into two cells containing roughly equal shares of these cellular components.

By "post-mitotic cell" it is meant a cell that has exited from mitosis, i.e., it is "quiescent", i.e. it is no longer undergoing divisions. This quiescent state may be temporary, i.e. reversible, or it may be permanent.

By "meiotic cell" it is meant a cell that is undergoing meiosis. Meiosis is the process by which a cell divides its nuclear material for the purpose of producing gametes or spores. Unlike mitosis, in meiosis, the chromosomes undergo a recombination step which shuffles genetic material between chromosomes. Additionally, the outcome of meiosis is four (genetically unique) haploid cells, as compared with the two (genetically identical) diploid cells produced from mitosis.

By "recombination" it is meant a process of exchange of genetic information between two polynucleotides. As used herein, "homology-directed repair (HDR)" refers to the specialized form DNA repair that takes place, for example, during repair of double-strand breaks in cells. This process requires nucleotide sequence homology, uses a "donor" molecule to template repair of a "target" molecule (i.e., the one that experienced the double-strand break), and leads to the transfer of genetic information from the donor to the target. Homology-directed repair may result in an alteration of the sequence of the target molecule (e.g., insertion, deletion, mutation), if the donor polynucleotide differs from the target molecule and part or all of the sequence of the donor polynucleotide is incorporated into the target DNA. In some embodiments, the donor polynucleotide, a portion of the donor polynucleotide, a copy of the donor polynucleotide, or a portion of a copy of the donor polynucleotide integrates into the target DNA.

By "non-homologous end joining (NHEJ)" it is meant the repair of double-strand breaks in DNA by direct ligation of the break ends to one another without the need for a homologous template (in contrast to homology-directed repair, which requires a homologous sequence to guide repair). NHEJ often results in the loss (deletion) of nucleotide sequence near the site of the double-strand break.

The terms "treatment", "treating" and the like are used herein to generally mean obtaining a desired pharmacologic and/or physiologic effect. The effect may be prophylactic in terms of completely or partially preventing a disease or symptom thereof and/or may be therapeutic in terms of a partial or complete cure for a disease and/or adverse effect attributable to the disease. "Treatment" as used herein covers any treatment of a disease or symptom in a mammal, and includes: (a) preventing the disease or symptom from occurring in a subject which may be predisposed to acquiring the disease or symptom but has not yet been diagnosed as having it; (b) inhibiting the disease or symptom, i.e., arresting its development; or (c) relieving the disease, i.e., causing regression of the disease. The therapeutic agent may be administered before, during or after the onset of disease or injury. The treatment of ongoing disease, where the treatment stabilizes or reduces the undesirable clinical symptoms of the patient, is of particular interest. Such treatment is desirably performed prior to complete loss of function in the affected tissues. The subject therapy will desirably be administered during the symptomatic stage of the disease, and in some cases after the symptomatic stage of the disease.

The terms "individual," "subject," "host," and "patient," are used interchangeably herein and refer to any mammalian subject for whom diagnosis, treatment, or therapy is desired, particularly humans.

General methods in molecular and cellular biochemistry can be found in such standard textbooks as Molecular Cloning: A Laboratory Manual, 3rd Ed. (Sambrook et al., HaRBor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Certain ranges are presented herein with numerical values being preceded by the term "about" The term "about" is used herein to provide literal support for the exact number that it precedes, as well as a number that is near to or approximately the number that the term precedes. In determining whether a number is near to or approximately a specifically recited number, the near or approximating unrecited number may be a number which, in the context in which it is presented, provides the substantial equivalent of the specifically recited number.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

All publications and patents cited in this specification are herein incorporated by reference as if each individual publication or patent were specifically and individually indicated to be incorporated by reference and are incorporated herein by reference to disclose and describe the methods and/or materials in connection with which the publications are cited. The citation of any publication is for its disclosure prior to the filing date and should not be construed as an admission that the present invention is not entitled to antedate such publication by virtue of prior invention. Further, the dates of publication provided may be different from the actual publication dates which may need to be independently confirmed.

It is noted that as used herein and in the appended claims, the singular forms "a," "an," and "the" include plural referents unless the context clearly dictates otherwise. Thus, for example, reference to "a polynucleotide" includes a plurality of such polynucleotides and reference to "the polypeptide" includes reference to one or more polypeptides and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

Detailed Description—Part I

The present disclosure provides a DNA-targeting RNA that comprises a targeting sequence and, together with a modifying polypeptide, provides for site-specific modification of a target DNA and/or a polypeptide associated with the target DNA. The present disclosure further provides site-specific modifying polypeptides. The present disclosure further provides methods of site-specific modification of a target DNA and/or a polypeptide associated with the target DNA The present disclosure provides methods of modulating transcription of a target nucleic acid in a target cell, generally involving contacting the target nucleic acid with an enzymatically inactive Cas9 polypeptide and a DNA-targeting RNA. Kits and compositions for carrying out the methods are also provided. The present disclosure provides genetically modified cells that produce Cas9; and Cas9 transgenic non-human multicellular organisms.

Nucleic Acids

DNA-Targeting RNA

The present disclosure provides a DNA-targeting RNA that directs the activities of an associated polypeptide (e.g., a site-directed modifying polypeptide) to a specific target sequence within a target DNA. A subject DNA-targeting RNA comprises: a first segment (also referred to herein as a "DNA-targeting segment" or a "DNA-targeting sequence") and a second segment (also referred to herein as a "protein-binding segment" or a "protein-binding sequence").

DNA-Targeting Segment of a DNA-Targeting RNA

The DNA-targeting segment of a subject DNA-targeting RNA comprises a nucleotide sequence that is complementary to a sequence in a target DNA. In other words, the DNA-targeting segment of a subject DNA-targeting RNA interacts with a target DNA in a sequence-specific manner via hybridization (i.e., base pairing). As such, the nucleotide sequence of the DNA-targeting segment may vary and determines the location within the target DNA that the DNA-targeting RNA and the target DNA will interact. The DNA-targeting segment of a subject DNA-targeting RNA can be modified (e.g., by genetic engineering) to hybridize to any desired sequence within a target DNA.

The DNA-targeting segment can have a length of from about 12 nucleotides to about 100 nucleotides. For example, the DNA-targeting segment can have a length of from about 12 nucleotides (nt) to about 80 nt, from about 12 nt to about 50 nt, from about 12 nt to about 40 nt, from about 12 nt to about 30 nt, from about 12 nt to about 25 nt, from about 12 nt to about 20 nt, or from about 12 nt to about 19 nt. For example, the DNA-targeting segment can have a length of from about 19 nt to about 20 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 19 nt to about 70 nt, from about 19 nt to about 80 nt, from about 19 nt to about 90 nt, from about 19 nt to about 100 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, from about 20 nt to about 60 nt, from about 20 nt to about 70 nt, from about 20 nt to about 80 nt, from about 20 nt to about 90 nt, or from about 20 nt to about 100 nt. The nucleotide sequence (the DNA-targeting sequence) of the DNA-targeting segment that is complementary to a nucleotide sequence (target sequence) of the target DNA can have a length at least about 12 nt. For example, the DNA-targeting sequence of the DNA-targeting segment that is complementary to a target sequence of the target DNA can have a length at least about 12 nt, at least about 15 nt, at least about 18 nt, at least about 19 nt, at least about 20 nt, at least about 25 nt, at least about 30 nt, at least about 35 nt or at least about 40 nt. For example, the DNA-targeting sequence of the DNA-targeting segment that is complementary to a target sequence of the target DNA can have a length of from about 12 nucleotides (nt) to about 80 nt, from about 12 nt to about 50 nt, from about 12 nt to about 45 nt, from about 12 nt to about 40 nt, from about 12 nt to about 35 nt, from about 12 nt to about 30 nt, from about 12 nt to about 25 nt, from about 12 nt to about 20 nt, from about 12 nt to about 19 nt, from about 19 nt to about 20 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. The nucleotide sequence (the DNA-targeting sequence) of the DNA-targeting segment that is complementary to a nucleotide sequence (target sequence) of the target DNA can have a length at least about 12 nt.

In some cases, the DNA-targeting sequence of the DNA-targeting segment that is complementary to a target sequence of the target DNA is 20 nucleotides in length. In some cases, the DNA-targeting sequence of the DNA-targeting segment that is complementary to a target sequence of the target DNA is 19 nucleotides in length.

The percent complementarity between the DNA-targeting sequence of the DNA-targeting segment and the target sequence of the target DNA can be at least 60% (e.g., at least 65%, at least 70%, at least 75%, at least 80%, at least 85%, at least 90%, at least 95%, at least 97%, at least 98%, at least 99%, or 100%). In some cases, the percent complementarity between the DNA-targeting sequence of the DNA-targeting segment and the target sequence of the target DNA is 100% over the seven contiguous 5'-most nucleotides of the target sequence of the complementary strand of the target DNA. In some cases, the percent complementarity between the DNA-targeting sequence of the DNA-targeting segment and the target sequence of the target DNA is at least 60% over about 20 contiguous nucleotides. In some cases, the percent complementarity between the DNA-targeting sequence of the DNA-targeting segment and the target sequence of the target DNA is 100% over the fourteen contiguous 5'-most nucleotides of the target sequence of the complementary strand of the target DNA and as low as 0% over the remainder. In such a case, the DNA-targeting sequence can be considered to be 14 nucleotides in length (see FIG. 12D-12E). In some cases, the percent complementarity between the DNA-targeting sequence of the DNA-targeting segment and the target sequence of the target DNA is 100% over the seven contiguous 5'-most nucleotides of the target sequence of the complementary strand of the target DNA and as low as 0% over the remainder. In such a case, the DNA-targeting sequence can be considered to be 7 nucleotides in length.

Protein-Binding Segment of a DNA-Targeting RNA

The protein-binding segment of a subject DNA-targeting RNA interacts with a site-directed modifying polypeptide. The subject DNA-targeting RNA guides the bound polypeptide to a specific nucleotide sequence within target DNA via the above mentioned DNA-targeting segment. The protein-binding segment of a subject DNA-targeting RNA comprises two stretches of nucleotides that are complementary to one another. The complementary nucleotides of the protein-binding segment hybridize to form a double stranded RNA duplex (dsRNA) (see FIGS. 1A and 1B).

Figure 1A:
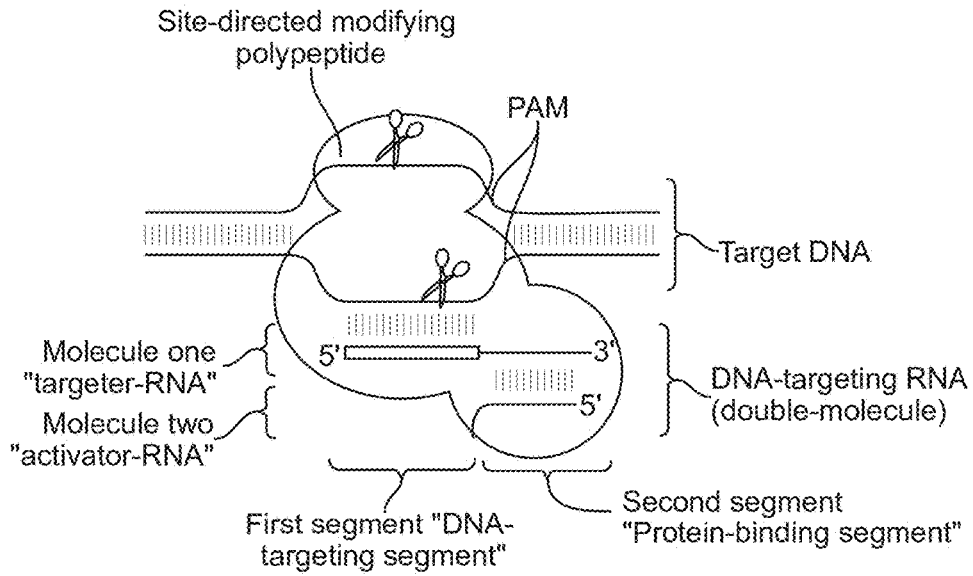
FIG. 1A-1B provide a schematic drawing of two exemplary subject DNA-targeting RNAs, each associated with a site-directed modifying polypeptide and with a target DNA.

A subject double-molecule DNA-targeting RNA comprises two separate RNA molecules. Each of the two RNA molecules of a subject double-molecule DNA-targeting RNA comprises a stretch of nucleotides that are complementary to one another such that the complementary nucleotides of the two RNA molecules hybridize to form the double stranded RNA duplex of the protein-binding segment (FIG. 1A).

In some embodiments, the duplex-forming segment of the activator-RNA is at least about 60% identical to one of the activator-RNA (tracrRNA) molecules set forth in SEQ ID NOs:431-562, or a complement thereof, over a stretch of at least 8 contiguous nucleotides. For example, the duplex-forming segment of the activator-RNA (or the DNA encoding the duplex-forming segment of the activator-RNA) is at least about 60% identical, at least about 65% identical, at least about 70% identical, at least about 75% identical, at least about 80% identical, at least about 85% identical, at least about 90% identical, at least about 95% identical, at least about 98% identical, at least about 99% identical, or 100% identical, to one of the tracrRNA sequences set forth in SEQ ID NOs:431-562, or a complement thereof, over a stretch of at least 8 contiguous nucleotides.

In some embodiments, the duplex-forming segment of the targeter-RNA is at least about 60% identical to one of the targeter-RNA (crRNA) sequences set forth in SEQ ID NOs: 563-679, or a complement thereof, over a stretch of at least 8 contiguous nucleotides. For example, the duplex-forming segment of the targeter-RNA (or the DNA encoding the duplex-forming segment of the targeter-RNA) is at least about 65% identical, at least about 70% identical, at least about 75% identical, at least about 80% identical, at least about 85% identical, at least about 90% identical, at least about 95% identical, at least about 98% identical, at least about 99% identical or 100% identical to one of the crRNA sequences set forth in SEQ ID NOs:563-679, or a complement thereof, over a stretch of at least 8 contiguous nucleotides.

A two-molecule DNA-targeting RNA can be designed to allow for controlled (i.e., conditional) binding of a targeter-RNA with an activator-RNA. Because a two-molecule DNA-targeting RNA is not functional unless both the activator-RNA and the targeter-RNA are bound in a functional complex with dCas9, a two-molecule DNA-targeting RNA can be inducible (e.g., drug inducible) by rendering the binding between the activator-RNA and the targeter-RNA to be inducible. As one non-limiting example, RNA aptamers can be used to regulate (i.e., control) the binding of the activator-RNA with the targeter-RNA. Accordingly, the activator-RNA and/or the targeter-RNA can comprise an RNA aptamer sequence.

RNA aptamers are known in the art and are generally a synthetic version of a riboswitch. The terms "RNA aptamer" and "riboswitch" are used interchangeably herein to encompass both synthetic and natural nucleic acid sequences that provide for inducible regulation of the structure (and therefore the availability of specific sequences) of the RNA molecule of which they are part. RNA aptamers usually comprise a sequence that folds into a particular structure (e.g., a hairpin), which specifically binds a particular drug (e.g., a small molecule). Binding of the drug causes a structural change in the folding of the RNA, which changes a feature of the nucleic acid of which the aptamer is a part. As non-limiting examples: (i) an activator-RNA with an aptamer may not be able to bind to the cognate targeter-RNA unless the aptamer is bound by the appropriate drug; (ii) a targeter-RNA with an aptamer may not be able to bind to the cognate activator-RNA unless the aptamer is bound by the appropriate drug; and (iii) a targeter-RNA and an activator-RNA, each comprising a different aptamer that binds a different drug, may not be able to bind to each other unless both drugs are present. As illustrated by these examples, a two-molecule DNA-targeting RNA can be designed to be inducible.

Examples of aptamers and riboswitches can be found, for example, in: Nakamura et al., Genes Cells. 2012 May; 17(5):344-64; Vavalle et al., Future Cardiol. 2012 May; 8(3):371-82; Citartan et al., Biosens Bioelectron. 2012 Apr. 15; 34(1):1-11; and Liberman et al., Wiley Interdiscip Rev RNA. 2012 May-June; 3(3):369-84; all of which are herein incorporated by reference in their entirety.

Non-limiting examples of nucleotide sequences that can be included in a two-molecule DNA-targeting RNA include either of the sequences set forth in SEQ ID NOs:431-562, or complements thereof pairing with any sequences set forth in SEQ ID NOs:563-679, or complements thereof that can hybridize to form a protein binding segment.

Figure 1B:
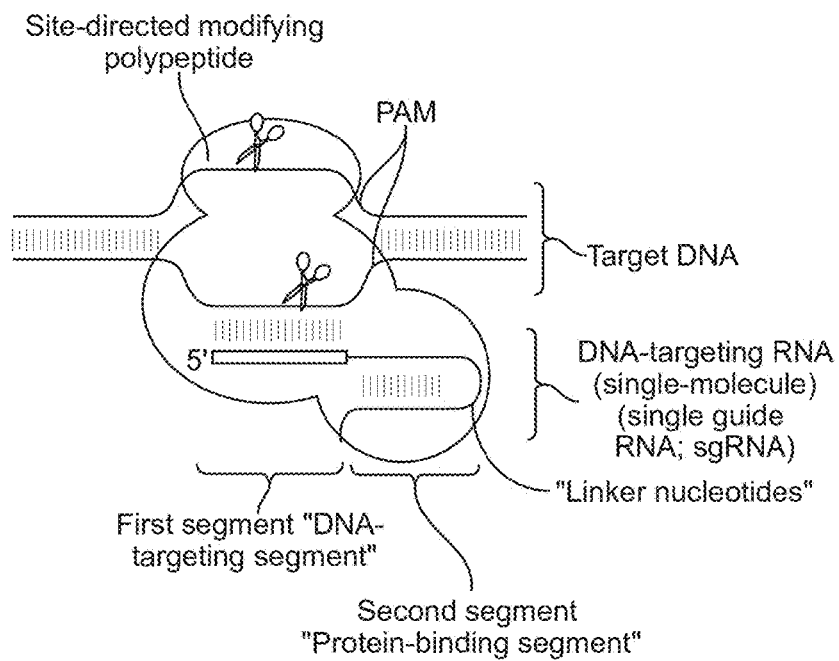

A subject single-molecule DNA-targeting RNA comprises two stretches of nucleotides (a targeter-RNA and an activator-RNA) that are complementary to one another, are covalently linked by intervening nucleotides ("linkers" or "linker nucleotides"), and hybridize to form the double stranded RNA duplex (dsRNA duplex) of the protein-binding segment, thus resulting in a stem-loop structure (FIG. 1B). The targeter-RNA and the activator-RNA can be covalently linked via the 3' end of the targeter-RNA and the 5' end of the activator-RNA. Alternatively, targeter-RNA and the activator-RNA can be covalently linked via the 5' end of the targeter-RNA and the 3' end of the activator-RNA.

The linker of a single-molecule DNA-targeting RNA can have a length of from about 3 nucleotides to about 100 nucleotides. For example, the linker can have a length of from about 3 nucleotides (nt) to about 90 nt, from about 3 nucleotides (nt) to about 80 nt, from about 3 nucleotides (nt) to about 70 nt, from about 3 nucleotides (nt) to about 60 nt, from about 3 nucleotides (nt) to about 50 nt, from about 3 nucleotides (nt) to about 40 nt, from about 3 nucleotides (nt) to about 30 nt, from about 3 nucleotides (nt) to about 20 nt or from about 3 nucleotides (nt) to about 10 nt. For example, the linker can have a length of from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. In some embodiments, the linker of a single-molecule DNA-targeting RNA is 4 nt.

An exemplary single-molecule DNA-targeting RNA comprises two complementary stretches of nucleotides that hybridize to form a dsRNA duplex. In some embodiments, one of the two complementary stretches of nucleotides of the single-molecule DNA-targeting RNA (or the DNA encoding the stretch) is at least about 60% identical to one of the activator-RNA (tracrRNA) molecules set forth in SEQ ID NOs:431-562, or a complement thereof, over a stretch of at least 8 contiguous nucleotides. For example, one of the two complementary stretches of nucleotides of the single-molecule DNA-targeting RNA (or the DNA encoding the stretch) is at least about 65% identical, at least about 70% identical, at least about 75% identical, at least about 80% identical, at least about 85% identical, at least about 90% identical, at least about 95% identical, at least about 98% identical, at least about 99% identical or 100% identical to one of the tracrRNA sequences set forth in SEQ ID NOs: 431-562, or a complement thereof, over a stretch of at least 8 contiguous nucleotides.

In some embodiments, one of the two complementary stretches of nucleotides of the single-molecule DNA-targeting RNA (or the DNA encoding the stretch) is at least about 60% identical to one of the targeter-RNA (crRNA) sequences set forth in SEQ ID NOs:563-679, or a complement thereof, over a stretch of at least 8 contiguous nucleotides. For example, one of the two complementary stretches of nucleotides of the single-molecule DNA-targeting RNA (or the DNA encoding the stretch) is at least about 65% identical, at least about 70% identical, at least about 75% identical, at least about 80% identical, at least about 85% identical, at least about 90% identical, at least about 95% identical, at least about 98% identical, at least about 99% identical or 100% identical to one of the crRNA sequences set forth in SEQ ID NOs:563-679, or a complement thereof, over a stretch of at least 8 contiguous nucleotides.

Appropriate naturally occurring cognate pairs of crRNAs and tracrRNAs can be routinely determined for SEQ ID NOs:431-679 by taking into account the species name and base-pairing (for the dsRNA duplex of the protein-binding domain) when determining appropriate cognate pairs (see FIG. 8 as a non-limiting example).

With regard to both a subject single-molecule DNA-targeting RNA and to a subject double-molecule DNA-targeting RNA, FIG. 57A-57B demonstrates that artificial sequences that share very little (roughly 50% identity) with naturally occurring a tracrRNAs and crRNAs can function with Cas9 to cleave target DNA as long as the structure of the protein-binding domain of the DNA-targeting RNA is conserved. Thus, RNA folding structure of a naturally occurring protein-binding domain of a DNA-targeting RNA can be taken into account in order to design artificial protein-binding domains (either two-molecule or single-molecule versions). As a non-limiting example, the functional artificial DNA-targeting RNA of FIG. 57A-57B was designed based on the structure of the protein-binding segment of the naturally occurring DNA-targeting (e.g., including the same number of base pairs along the RNA duplex and including the same "buldge" region as present in the naturally occurring RNA). As structures can readily be produced by one of ordinary skill in the art for any naturally occurring crRNA:tracrRNA pair from any species (see SEQ ID NOs:431-679 for crRNA and tracrRNA sequences from a wide variety of species), an artificial DNA-targeting-RNA can be designed to mimic the natural structure for a given species when using the Cas9 (or a related Cas9, see FIG. 32A) from that species. (see FIG. 24D and related details in Example 1). Thus, a suitable DNA-targeting RNA can be an artificially designed RNA (non-naturally occurring) comprising a protein-binding domain that was designed to mimic the structure of a protein-binding domain of a naturally occurring DNA-targeting RNA. (see SEQ ID NOs:431-679, taking into account the species name when determining appropriate cognate pairs).

The protein-binding segment can have a length of from about 10 nucleotides to about 100 nucleotides. For example, the protein-binding segment can have a length of from about 15 nucleotides (nt) to about 80 nt, from about 15 nt to about 50 nt, from about 15 nt to about 40 nt, from about 15 nt to about 30 nt or from about 15 nt to about 25 nt.

Also with regard to both a subject single-molecule DNA-targeting RNA and to a subject double-molecule DNA-targeting RNA, the dsRNA duplex of the protein-binding segment can have a length from about 6 base pairs (bp) to about 50 bp. For example, the dsRNA duplex of the protein-binding segment can have a length from about 6 bp to about 40 bp, from about 6 bp to about 30 bp, from about 6 bp to about 25 bp, from about 6 bp to about 20 bp, from about 6 bp to about 15 bp, from about 8 bp to about 40 bp, from about 8 bp to about 30 bp, from about 8 bp to about 25 bp, from about 8 bp to about 20 bp or from about 8 bp to about 15 bp. For example, the dsRNA duplex of the protein-binding segment can have a length from about from about 8 bp to about 10 bp, from about 10 bp to about 15 bp, from about 15 bp to about 18 bp, from about 18 bp to about 20 bp, from about 20 bp to about 25 bp, from about 25 bp to about 30 bp, from about 30 bp to about 35 bp, from about 35 bp to about 40 bp, or from about 40 bp to about 50 bp. In some embodiments, the dsRNA duplex of the protein-binding segment has a length of 36 base pairs. The percent complementarity between the nucleotide sequences that hybridize to form the dsRNA duplex of the protein-binding segment can be at least about 60%. For example, the percent complementarity between the nucleotide sequences that hybridize to form the dsRNA duplex of the protein-binding segment can be at least about 65%, at least about 70%, at least about 75%, at least about 80%, at least about 85%, at least about 90%, at least about 95%, at least about 98%, or at least about 99%. In some cases, the percent complementarity between the nucleotide sequences that hybridize to form the dsRNA duplex of the protein-binding segment is 100%.

Site-Directed Modifying Polypeptide

A subject DNA-targeting RNA and a subject site-directed modifying polypeptide form a complex. The DNA-targeting RNA provides target specificity to the complex by comprising a nucleotide sequence that is complementary to a sequence of a target DNA (as noted above). The site-directed modifying polypeptide of the complex provides the site-specific activity. In other words, the site-directed modifying polypeptide is guided to a DNA sequence (e.g. a chromosomal sequence or an extrachromosomal sequence, e.g. an episomal sequence, a minicircle sequence, a mitochondrial sequence, a chloroplast sequence, etc.) by virtue of its association with at least the protein-binding segment of the DNA-targeting RNA (described above).

A subject site-directed modifying polypeptide modifies target DNA (e.g., cleavage or methylation of target DNA) and/or a polypeptide associated with target DNA (e.g., methylation or acetylation of a histone tail). A site-directed modifying polypeptide is also referred to herein as a "site-directed polypeptide" or an "RNA binding site-directed modifying polypeptide."

In some cases, the site-directed modifying polypeptide is a naturally-occurring modifying polypeptide. In other cases, the site-directed modifying polypeptide is not a naturally-occurring polypeptide (e.g., a chimeric polypeptide as discussed below or a naturally-occurring polypeptide that is modified, e.g., mutation, deletion, insertion).

Exemplary naturally-occurring site-directed modifying polypeptides are set forth in SEQ ID NOs:1-255 as a non-limiting and non-exhaustive list of naturally occurring Cas9/Csn1 endonucleases. These naturally occurring polypeptides, as disclosed herein, bind a DNA-targeting RNA, are thereby directed to a specific sequence within a target DNA, and cleave the target DNA to generate a double strand break. A subject site-directed modifying polypeptide comprises two portions, an RNA-binding portion and an activity portion. In some embodiments, a subject site-directed modifying polypeptide comprises: (i) an RNA-binding portion that interacts with a DNA-targeting RNA, wherein the DNA-targeting RNA comprises a nucleotide sequence that is complementary to a sequence in a target DNA; and (ii) an activity portion that exhibits site-directed enzymatic activity (e.g., activity for DNA methylation, activity for DNA cleavage, activity for histone acetylation, activity for histone methylation, etc.), wherein the site of enzymatic activity is determined by the DNA-targeting RNA.

In other embodiments, a subject site-directed modifying polypeptide comprises: (i) an RNA-binding portion that interacts with a DNA-targeting RNA, wherein the DNA-targeting RNA comprises a nucleotide sequence that is complementary to a sequence in a target DNA; and (ii) an activity portion that modulates transcription within the target DNA (e.g., to increase or decrease transcription), wherein the site of modulated transcription within the target DNA is determined by the DNA-targeting RNA.

In some cases, a subject site-directed modifying polypeptide has enzymatic activity that modifies target DNA (e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity).

In other cases, a subject site-directed modifying polypeptide has enzymatic activity that modifies a polypeptide (e.g., a histone) associated with target DNA (e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity).

Exemplary Site-Directed Modifying Polypeptides

In some cases, the site-directed modifying polypeptide comprises an amino acid sequence having at least about 75%, at least about 80%, at least about 85%, at least about 90%, at least about 95%, at least about 99%, or 100%, amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346.

Nucleic Acid Modifications

In some embodiments, a subject nucleic acid (e.g., a DNA-targeting RNA) comprises one or more modifications, e.g., a base modification, a backbone modification, etc, to provide the nucleic acid with a new or enhanced feature (e.g., improved stability). As is known in the art, a nucleoside is a base-sugar combination. The base portion of the nucleoside is normally a heterocyclic base. The two most common classes of such heterocyclic bases are the purines and the pyrimidines. Nucleotides are nucleosides that further include a phosphate group covalently linked to the sugar portion of the nucleoside. For those nucleosides that include a pentofuranosyl sugar, the phosphate group can be linked to the 2', the 3', or the 5' hydroxyl moiety of the sugar. In forming oligonucleotides, the phosphate groups covalently link adjacent nucleosides to one another to form a linear polymeric compound. In turn, the respective ends of this linear polymeric compound can be further joined to form a circular compound, however, linear compounds are generally suitable. In addition, linear compounds may have internal nucleotide base complementarity and may therefore fold in a manner as to produce a fully or partially double-stranded compound. Within oligonucleotides, the phosphate groups are commonly referred to as forming the internucleoside backbone of the oligonucleotide. The normal linkage or backbone of RNA and DNA is a 3' to 5' phosphodiester linkage.

Modified Backbones and Modified Internucleoside Linkages

Examples of suitable nucleic acids containing modifications include nucleic acids containing modified backbones or non-natural internucleoside linkages. Nucleic acids (having modified backbones include those that retain a phosphorus atom in the backbone and those that do not have a phosphorus atom in the backbone.

Suitable modified oligonucleotide backbones containing a phosphorus atom therein include, for example, phosphorothioates, chiral phosphorothioates, phosphorodithioates, phosphotriesters, aminoalkylphosphotriesters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, phosphorodiamidates, thionophosphoramidates, thionoalkylphosphonates, thionoalkylphosphotriesters, selenophosphates and boranophosphates having normal 3'-5' linkages, 2'-5' linked analogs of these, and those having inverted polarity wherein one or more internucleotide linkages is a 3' to 3',5' to 5' or 2' to 2' linkage. Suitable oligonucleotides having inverted polarity comprise a single 3' to 3' linkage at the 3'-most internucleotide linkage i.e. a single inverted nucleoside residue which may be a basic (the nucleobase is missing or has a hydroxyl group in place thereof). Various salts (such as, for example, potassium or sodium), mixed salts and free acid forms are also included.

In some embodiments, a subject nucleic acid comprises one or more phosphorothioate and/or heteroatom internucleoside linkages, in particular —$CH_2$—NH—O—$CH_2$—, —$CH_2$—N($CH_3$)—O—$CH_2$— (known as a methylene(methylimino) or MMI backbone), —$CH_2$—O—N($CH_3$)—$CH_2$—, —$CH_2$—N($CH_3$)—N($CH_3$)—$CH_2$— and —O—N($CH_3$)—$CH_2$—$CH_2$— (wherein the native phosphodiester internucleotide linkage is represented as —O—P(=O)(OH)—O—$CH_2$—). MMI type internucleoside linkages are disclosed in the above referenced U.S. Pat. No. 5,489,677. Suitable amide internucleoside linkages are disclosed in t U.S. Pat. No. 5,602,240.

Also suitable are nucleic acids having morpholino backbone structures as described in, e.g., U.S. Pat. No. 5,034,506. For example, in some embodiments, a subject nucleic acid comprises a 6-membered morpholino ring in place of a ribose ring. In some of these embodiments, a phosphorodiamidate or other non-phosphodiester internucleoside linkage replaces a phosphodiester linkage.

Suitable modified polynucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; riboacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Mimetics

A subject nucleic acid can be a nucleic acid mimetic. The term "mimetic" as it is applied to polynucleotides is intended to include polynucleotides wherein only the furanose ring or both the furanose ring and the internucleotide linkage are replaced with non-furanose groups, replacement of only the furanose ring is also referred to in the art as being a sugar surrogate. The heterocyclic base moiety or a modified heterocyclic base moiety is maintained for hybridization with an appropriate target nucleic acid. One such nucleic acid, a polynucleotide mimetic that has been shown to have excellent hybridization properties, is referred to as a peptide nucleic acid (PNA). In PNA, the sugar-backbone of a polynucleotide is replaced with an amide containing backbone, in particular an aminoethylglycine backbone. The nucleotides are retained and are bound directly or indirectly to aza nitrogen atoms of the amide portion of the backbone.

One polynucleotide mimetic that has been reported to have excellent hybridization properties is a peptide nucleic acid (PNA). The backbone in PNA compounds is two or more linked aminoethylglycine units which gives PNA an amide containing backbone. The heterocyclic base moieties are bound directly or indirectly to aza nitrogen atoms of the amide portion of the backbone. Representative U.S. patents that describe the preparation of PNA compounds include, but are not limited to: U.S. Pat. Nos. 5,539,082; 5,714,331; and 5,719,262.

Another class of polynucleotide mimetic that has been studied is based on linked morpholino units (morpholino nucleic acid) having heterocyclic bases attached to the morpholino ring. A number of linking groups have been reported that link the morpholino monomeric units in a morpholino nucleic acid. One class of linking groups has been selected to give a non-ionic oligomeric compound. The non-ionic morpholino-based oligomeric compounds are less likely to have undesired interactions with cellular proteins. Morpholino-based polynucleotides are non-ionic mimics of oligonucleotides which are less likely to form undesired interactions with cellular proteins (Dwaine A. Braasch and David R. Corey, Biochemistry, 2002, 41(14), 4503-4510). Morpholino-based polynucleotides are disclosed in U.S. Pat. No. 5,034,506. A variety of compounds within the morpholino class of polynucleotides have been prepared, having a variety of different linking groups joining the monomeric subunits.

A further class of polynucleotide mimetic is referred to as cyclohexenyl nucleic acids (CeNA). The furanose ring normally present in a DNA/RNA molecule is replaced with a cyclohexenyl ring. CeNA DMT protected phosphoramidite monomers have been prepared and used for oligomeric compound synthesis following classical phosphoramidite chemistry. Fully modified CeNA oligomeric compounds and oligonucleotides having specific positions modified with CeNA have been prepared and studied (see Wang et al., J. Am. Chem. Soc., 2000, 122, 8595-8602). In general the incorporation of CeNA monomers into a DNA chain increases its stability of a DNA/RNA hybrid. CeNA oligoadenylates formed complexes with RNA and DNA complements with similar stability to the native complexes. The study of incorporating CeNA structures into natural nucleic acid structures was shown by NMR and circular dichroism to proceed with easy conformational adaptation.

A further modification includes Locked Nucleic Acids (LNAs) in which the 2'-hydroxyl group is linked to the 4' carbon atom of the sugar ring thereby forming a 2'-C,4'-C-oxymethylene linkage thereby forming a bicyclic sugar moiety. The linkage can be a methylene (—$CH_2$—), group bridging the 2' oxygen atom and the 4' carbon atom wherein n is 1 or 2 (Singh et al., Chem. Commun., 1998, 4, 455-456). LNA and LNA analogs display very high duplex thermal stabilities with complementary DNA and RNA (Tm=+3 to +10° C.), stability towards 3'-exonucleolytic degradation and good solubility properties. Potent and nontoxic antisense oligonucleotides containing LNAs have been described (Wahlestedt et al., Proc. Natl. Acad. Sci. U.S.A., 2000, 97, 5633-5638).

The synthesis and preparation of the LNA monomers adenine, cytosine, guanine, 5-methylcytosine, thymine and uracil, along with their oligomerization, and nucleic acid recognition properties have been described (Koshkin et al., Tetrahedron, 1998, 54, 3607-3630). LNAs and preparation thereof are also described in WO 98/39352 and WO 99/14226.

Modified Sugar Moieties

A subject nucleic acid can also include one or more substituted sugar moieties. Suitable polynucleotides comprise a sugar substituent group selected from: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Particularly suitable are $O((CH_2)_nO)_mCH_3$, $O(CH_2)_nOCH_3$, $O(CH_2)_nNH_2$, $O(CH_2)_nCH_3$, $O(CH_2)_nONH_2$, and $O(CH_2)_nON((CH_2)_nCH_3)_2$, where n and m are from 1 to about 10. Other suitable polynucleotides comprise a sugar substituent group selected from: $C_1$ to $C_{10}$ lower alkyl, substituted lower alkyl, alkenyl, alkynyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. A suitable modification includes 2'-methoxyethoxy(2'-O—$CH_2CH_2OCH_3$, also known as 2'-O-(2-methoxyethyl) or 2'-MOE) (Martin et al., Helv. Chim Acta, 1995, 78, 486-504) i.e., an alkoxyalkoxy group. A further suitable modification includes 2'-dimethylaminooxyethoxy, i.e., a $O(CH_2)_2ON(CH_3)_2$ group, also known as 2'-DMAOE, as described in examples hereinbelow, and 2'-dimethylaminoethoxyethoxy (also known in the art as 2'-O-dimethyl-amino-ethoxy-ethyl or 2'-DMAEOE), i.e., 2'-O—$CH_2$—O—$CH_2$—$N(CH_3)_2$.

Other suitable sugar substituent groups include methoxy (—O—$CH_3$), aminopropoxy (—$OCH_2CH_2CH_2NH_2$), allyl (—$CH_2$—CH=$CH_2$), —O-allyl $CH_2$—CH=$CH_2$) and fluoro (F). 2'-sugar substituent groups may be in the arabino (up) position or ribo (down) position. A suitable 2'-arabino modification is 2'-F. Similar modifications may also be made at other positions on the oligomeric compound, particularly the 3' position of the sugar on the 3' terminal nucleoside or in 2'-5' linked oligonucleotides and the 5' position of 5' terminal nucleotide. Oligomeric compounds may also have sugar mimetics such as cyclobutyl moieties in place of the pentofuranosyl sugar.

Base Modifications and Substitutions

A subject nucleic acid may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—$CH_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-aminoadenine, 8-azaguanine and 8-azaadenine, 7-deazaguanine and 7-deazaadenine and 3-deazaguanine and 3-deazaadenine. Further modified nucleobases include tricyclic pyrimidines such as phenoxazine cytidine(1H-pyrimido(5,4-b)(1,4)benzoxazin-2(3H)-one), phenothiazine cytidine (1H-pyrimido(5,4-b)(1,4)benzothiazin-2(3H)-one), G-clamps such as a substituted phenoxazine cytidine (e.g. 9-(2-aminoethoxy)-H-pyrimido(5,4-(b) (1,4)benzoxazin-2(3H)-one), carbazole cytidine (2H-pyrimido(4,5-b)indol-2-one), pyridoindole cytidine (H-pyrido(3',2':4,5)pyrrolo(2,3-d)pyrimidin-2-one).

Heterocyclic base moieties may also include those in which the purine or pyrimidine base is replaced with other heterocycles, for example 7-deaza-adenine, 7-deazaguanosine, 2-aminopyridine and 2-pyridone. Further nucleobases include those disclosed in U.S. Pat. No. 3,687,808, those disclosed in The Concise Encyclopedia Of Polymer Science And Engineering, pages 858-859, Kroschwitz, J. I., ed. John Wiley & Sons, 1990, those disclosed by Englisch et al., Angewandte Chemie, International Edition, 1991, 30, 613, and those disclosed by Sanghvi, Y. S., Chapter 15, Antisense Research and Applications, pages 289-302, Crooke, S. T. and Lebleu, B., ed., CRC Press, 1993. Certain of these nucleobases are useful for increasing the binding affinity of an oligomeric compound. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi et al., eds., Antisense Research and Applications, CRC Press, Boca Raton, 1993, pp. 276-278) and are suitable base substitutions, e.g., when combined with 2'-O-methoxyethyl sugar modifications.

Conjugates

Another possible modification of a subject nucleic acid involves chemically linking to the polynucleotide one or more moieties or conjugates which enhance the activity, cellular distribution or cellular uptake of the oligonucleotide. These moieties or conjugates can include conjugate groups covalently bound to functional groups such as primary or secondary hydroxyl groups. Conjugate groups include, but are not limited to, intercalators, reporter molecules, polyamines, polyamides, polyethylene glycols, polyethers, groups that enhance the pharmacodynamic properties of oligomers, and groups that enhance the pharmacokinetic properties of oligomers. Suitable conjugate groups include, but are not limited to, cholesterols, lipids, phospholipids, biotin, phenazine, folate, phenanthridine, anthraquinone, acridine, fluoresceins, rhodamines, coumarins, and dyes. Groups that enhance the pharmacodynamic properties include groups that improve uptake, enhance resistance to degradation, and/or strengthen sequence-specific hybridization with the target nucleic acid. Groups that enhance the pharmacokinetic properties include groups that improve uptake, distribution, metabolism or excretion of a subject nucleic acid.

Conjugate moieties include but are not limited to lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al., Ann. N.Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys.

Acta, 1995, 1264, 229-237), or an octadecylamine or hexylamino-carbonyl-oxycholesterol moiety (Crooke et al., J. Pharmacol. Exp. Ther., 1996, 277, 923-937.\

A conjugate may include a "Protein Transduction Domain" or PTD (also known as a CPP—cell penetrating peptide), which may refer to a polypeptide, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from extracellular space to intracellular space, or cytosol to within an organelle. In some embodiments, a PTD is covalently linked to the amino terminus of an exogenous polypeptide (e.g., a site-directed modifying polypeptide). In some embodiments, a PTD is covalently linked to the carboxyl terminus of an exogenous polypeptide (e.g., a site-directed modifying polypeptide). In some embodiments, a PTD is covalently linked to a nucleic acid (e.g., a DNA-targeting RNA, a polynucleotide encoding a DNA-targeting RNA, a polynucleotide encoding a site-directed modifying polypeptide, etc.). Exemplary PTDs include but are not limited to a minimal undecapeptide protein transduction domain (corresponding to residues 47-57 of HIV-1 TAT comprising YGRKKRRQRRR; SEQ ID NO:264); a polyarginine sequence comprising a number of arginines sufficient to direct entry into a cell (e.g., 3, 4, 5, 6, 7, 8, 9, 10, or 10-50 arginines); a VP22 domain (Zender et al. (2002) Cancer Gene Ther. 9(6):489-96); an Drosophila Antennapedia protein transduction domain (Noguchi et al. (2003) Diabetes 52(7):1732-1737); a truncated human calcitonin peptide (Trehin et al. (2004) Pharm. Research 21:1248-1256); polylysine (Wender et al. (2000) Proc. Natl. Acad. Sci. USA 97:13003-13008); RRQRRTSKLMKR (SEQ ID NO:265); Transportan GWTLNSAGYLLGKINLKA-LAALAKKIL (SEQ ID NO:266); KALAWEAKLAKA-LAKALAKHLAKALAKALKCEA (SEQ ID NO:267); and RQIKIWFQNRRMKWKK (SEQ ID NO:268). Exemplary PTDs include but are not limited to, YGRKKRRQRRR (SEQ ID NO:264), RKKRRQRRR (SEQ ID NO:269); an arginine homopolymer of from 3 arginine residues to 50 arginine residues; Exemplary PTD domain amino acid sequences include, but are not limited to, any of the following: YGRKKRRQRRR (SEQ ID NO:264); RKKRRQRR (SEQ ID NO:270); YARAAARQARA (SEQ ID NO:271); THRLPRRRRRR (SEQ ID NO:272); and GGRRAR-RRRRR (SEQ ID NO:273). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane.

Exemplary DNA-Targeting RNAs

In some embodiments, a suitable DNA-targeting RNA comprises two separate RNA polynucleotide molecules. The first of the two separate RNA polynucleotide molecules (the activator-RNA) comprises a nucleotide sequence having at least about 60%, at least about 65%, at least about 70%, at least about 75%, at least about 80%, at least about 85%, at least about 90%, at least about 95%, at least about 98%, at least about 99%, or 100% nucleotide sequence identity over a stretch of at least 8 contiguous nucleotides to any one of the nucleotide sequences set forth in SEQ ID NOs:431-562, or complements thereof. The second of the two separate RNA polynucleotide molecules (the targeter-RNA) comprises a nucleotide sequence having at least about 60%, at least about 65%, at least about 70%, at least about 75%, at least about 80%, at least about 85%, at least about 90%, at least about 95%, at least about 98%, at least about 99%, or 100% nucleotide sequence identity over a stretch of at least 8 contiguous nucleotides to any one of the nucleotide sequences set forth in SEQ ID NOs:563-679, or complements thereof.

In some embodiments, a suitable DNA-targeting RNA is a single RNA polynucleotide and comprises a first nucleotide sequence having at least about 60%, at least about 65%, at least about 70%, at least about 75%, at least about 80%, at least about 85%, at least about 90%, at least about 95%, at least about 98%, at least about 99%, or 100% nucleotide sequence identity over a stretch of at least 8 contiguous nucleotides to any one of the nucleotide sequences set forth in SEQ ID NOs:431-562 and a second nucleotide sequence having at least about 60%, at least about 65%, at least about 70%, at least about 75%, at least about 80%, at least about 85%, at least about 90%, at least about 95%, at least about 98%, at least about 99%, or 100% nucleotide sequence identity over a stretch of at least 8 contiguous nucleotides to any one of the nucleotide sequences set forth in SEQ ID NOs: 463-679.

In some embodiments, the DNA-targeting RNA is a double-molecule DNA-targeting RNA and the targeter-RNA comprises the sequence 5'GUUUUAGAGCUA-3' (SEQ ID NO:679) linked at its 5' end to a stretch of nucleotides that are complementary to a target DNA. In some embodiments, the DNA-targeting RNA is a double-molecule DNA-targeting RNA and the activator-RNA comprises the sequence 5' UAGCAAGUUAAAAUAAGGCUAGUCCG-3' (SEQ ID NO: 397).

In some embodiments, the DNA-targeting RNA is a single-molecule DNA-targeting RNA and comprises the sequence 5'-GUUUUAGAGCUA-linker-UAG-CAAGUUAAAAUAAGGCUAGUCCG-3' linked at its 5' end to a stretch of nucleotides that are complementary to a target DNA (where "linker" denotes any a linker nucleotide sequence that can comprise any nucleotide sequence) (SEQ ID NO: 680). Other exemplary single-molecule DNA-targeting RNAs include those set forth in SEQ ID NOs: 680-682.

Nucleic Acids Encoding a Subject DNA-Targeting RNA and/or a Subject Site-Directed Modifying Polypeptide The present disclosure provides a nucleic acid comprising a nucleotide sequence encoding a subject DNA-targeting RNA and/or a subject site-directed modifying polypeptide. In some embodiments, a subject DNA-targeting RNA-encoding nucleic acid is an expression vector, e.g., a recombinant expression vector.

In some embodiments, a subject method involves contacting a target DNA or introducing into a cell (or a population of cells) one or more nucleic acids comprising nucleotide sequences encoding a DNA-targeting RNA and/or a site-directed modifying polypeptide. In some embodiments a cell comprising a target DNA is in vitro. In some embodiments a cell comprising a target DNA is in vivo. Suitable nucleic acids comprising nucleotide sequences encoding a DNA-targeting RNA and/or a site-directed modifying polypeptide include expression vectors, where an expression vector comprising a nucleotide sequence encoding a DNA-targeting RNA and/or a site-directed modifying polypeptide is a "recombinant expression vector."

In some embodiments, the recombinant expression vector is a viral construct, e.g., a recombinant adeno-associated virus construct (see, e.g., U.S. Pat. No. 7,078,387), a recombinant adenoviral construct, a recombinant lentiviral construct, a recombinant retroviral construct, etc.

Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like.

Numerous suitable expression vectors are known to those of skill in the art, and many are commercially available. The following vectors are provided by way of example; for eukaryotic host cells: pXT1, pSG5 (Stratagene), pSVK3, pBPV, pMSG, and pSVLSV40 (Pharmacia). However, any other vector may be used so long as it is compatible with the host cell.

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology,* 153:516-544).

In some embodiments, a nucleotide sequence encoding a DNA-targeting RNA and/or a site-directed modifying polypeptide is operably linked to a control element, e.g., a transcriptional control element, such as a promoter. The transcriptional control element may be functional in either a eukaryotic cell, e.g., a mammalian cell; or a prokaryotic cell (e.g., bacterial or archaeal cell). In some embodiments, a nucleotide sequence encoding a DNA-targeting RNA and/or a site-directed modifying polypeptide is operably linked to multiple control elements that allow expression of the nucleotide sequence encoding a DNA-targeting RNA and/or a site-directed modifying polypeptide in both prokaryotic and eukaryotic cells.

Non-limiting examples of suitable eukaryotic promoters (promoters functional in a eukaryotic cell) include those from cytomegalovirus (CMV) immediate early, herpes simplex virus (HSV) thymidine kinase, early and late SV40, long terminal repeats (LTRs) from retrovirus, and mouse metallothionein-I. Selection of the appropriate vector and promoter is well within the level of ordinary skill in the art. The expression vector may also contain a ribosome binding site for translation initiation and a transcription terminator. The expression vector may also include appropriate sequences for amplifying expression. The expression vector may also include nucleotide sequences encoding protein tags (e.g., 6×His tag, hemagglutinin tag, green fluorescent protein, etc.) that are fused to the site-directed modifying polypeptide, thus resulting in a chimeric polypeptide.

In some embodiments, a nucleotide sequence encoding a DNA-targeting RNA and/or a site-directed modifying polypeptide is operably linked to an inducible promoter. In some embodiments, a nucleotide sequence encoding a DNA-targeting RNA and/or a site-directed modifying polypeptide is operably linked to a constitutive promoter.

Methods of introducing a nucleic acid into a host cell are known in the art, and any known method can be used to introduce a nucleic acid (e.g., an expression construct) into a cell. Suitable methods include e.g., viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et., al Adv Drug Deliv Rev. 2012 Sep. 13. pii: S0169-409X(12)00283-9. doi: 10.1016/j.addr.2012.09.023), and the like.

Chimeric Polypeptides

The present disclosure provides a chimeric site-directed modifying polypeptide. A subject chimeric site-directed modifying polypeptide interacts with (e.g., binds to) a subject DNA-targeting RNA (described above). The DNA-targeting RNA guides the chimeric site-directed modifying polypeptide to a target sequence within target DNA (e.g. a chromosomal sequence or an extrachromosomal sequence, e.g. an episomal sequence, a minicircle sequence, a mitochondrial sequence, a chloroplast sequence, etc.). A subject chimeric site-directed modifying polypeptide modifies target DNA (e.g., cleavage or methylation of target DNA) and/or a polypeptide associated with target DNA (e.g., methylation or acetylation of a histone tail).

A subject chimeric site-directed modifying polypeptide modifies target DNA (e.g., cleavage or methylation of target DNA) and/or a polypeptide associated with target DNA (e.g., methylation or acetylation of a histone tail). A chimeric site-directed modifying polypeptide is also referred to herein as a "chimeric site-directed polypeptide" or a "chimeric RNA binding site-directed modifying polypeptide."

A subject chimeric site-directed modifying polypeptide comprises two portions, an RNA-binding portion and an activity portion. A subject chimeric site-directed modifying polypeptide comprises amino acid sequences that are derived from at least two different polypeptides. A subject chimeric site-directed modifying polypeptide can comprise modified and/or naturally-occurring polypeptide sequences (e.g., a first amino acid sequence from a modified or unmodified Cas9/Csn1 protein; and a second amino acid sequence other than the Cas9/Csn1 protein).

RNA-Binding Portion

In some cases, the RNA-binding portion of a subject chimeric site-directed modifying polypeptide is a naturally-occurring polypeptide. In other cases, the RNA-binding portion of a subject chimeric site-directed modifying polypeptide is not a naturally-occurring molecule (modified, e.g., mutation, deletion, insertion). Naturally-occurring RNA-binding portions of interest are derived from site-directed modifying polypeptides known in the art. For example, SEQ ID NOs:1-256 and 795-1346 provide a non-limiting and non-exhaustive list of naturally occurring Cas9/Csn1 endonucleases that can be used as site-directed modifying polypeptides. In some cases, the RNA-binding portion of a subject chimeric site-directed modifying polypeptide comprises an amino acid sequence having at least about 75%, at least about 80%, at least about 85%, at least about 90%, at least about 95%, at least about 98%, at least about 99%, or 100%, amino acid sequence identity to the RNA-binding portion of a polypeptide having any of the amino acid sequences set forth as SEQ ID NOs:1-256 and 795-1346).

In some cases, the site-directed modifying polypeptide comprises an amino acid sequence having at least about 75%, at least about 80%, at least about 85%, at least about 90%, at least about 95%, at least about 99%, or 100%, amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346.

Activity Portion

In addition to the RNA-binding portion, the chimeric site-directed modifying polypeptide comprises an "activity portion." In some embodiments, the activity portion of a subject chimeric site-directed modifying polypeptide comprises the naturally-occurring activity portion of a site-directed modifying polypeptide (e.g., Cas9/Csn1 endonuclease). In other embodiments, the activity portion of a subject chimeric site-directed modifying polypeptide comprises a modified amino acid sequence (e.g., substitution, deletion, insertion) of a naturally-occurring activity portion of a site-directed modifying polypeptide. Naturally-occurring activity portions of interest are derived from site-directed modifying polypeptides known in the art. For example, SEQ ID NOs:1-256 and 795-1346 provide a non-limiting and non-exhaustive list of naturally occurring Cas9/Csn1 endonucleases that can be used as site-directed modifying polypeptides. The activity portion of a subject chimeric site-directed modifying polypeptide is variable and may comprise any heterologous polypeptide sequence that may be useful in the methods disclosed herein.

In some embodiments, a subject chimeric site-directed modifying polypeptide comprises: (i) an RNA-binding portion that interacts with a DNA-targeting RNA, wherein the DNA-targeting RNA comprises a nucleotide sequence that is complementary to a sequence in a target DNA; and (ii) an activity portion that exhibits site-directed enzymatic activity (e.g., activity for DNA methylation, activity for DNA cleavage, activity for histone acetylation, activity for histone methylation, etc.), wherein the site of enzymatic activity is determined by the DNA-targeting RNA.

In other embodiments, a subject chimeric site-directed modifying polypeptide comprises: (i) an RNA-binding portion that interacts with a DNA-targeting RNA, wherein the DNA-targeting RNA comprises a nucleotide sequence that is complementary to a sequence in a target DNA; and (ii) an activity portion that modulates transcription within the target DNA (e.g., to increase or decrease transcription), wherein the site of modulated transcription within the target DNA is determined by the DNA-targeting RNA.

In some cases, the activity portion of a subject chimeric site-directed modifying polypeptide has enzymatic activity that modifies target DNA (e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity).

In other cases, the activity portion of a subject chimeric site-directed modifying polypeptide has enzymatic activity (e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity) that modifies a polypeptide associated with target DNA (e.g., a histone).

In some cases, the activity portion of a subject chimeric site-directed modifying polypeptide exhibits enzymatic activity (described above). In other cases, the activity portion of a subject chimeric site-directed modifying polypeptide modulates transcription of the target DNA (described above). The activity portion of a subject chimeric site-directed modifying polypeptide is variable and may comprise any heterologous polypeptide sequence that may be useful in the methods disclosed herein.

Exemplary Chimeric Site-Directed Modifying Polypeptides

In some embodiments, the activity portion of the chimeric site-directed modifying polypeptide comprises a modified form of the Cas9/Csn1 protein. In some instances, the modified form of the Cas9/Csn1 protein comprises an amino acid change (e.g., deletion, insertion, or substitution) that reduces the naturally-occurring nuclease activity of the Cas9/Csn1 protein. For example, in some instances, the modified form of the Cas9/Csn1 protein has less than 50%, less than 40%, less than 30%, less than 20%, less than 10%, less than 5%, or less than 1% of the nuclease activity of the corresponding wild-type Cas9/Csn1 polypeptide. In some cases, the modified form of the Cas9/Csn1 polypeptide has no substantial nuclease activity.

In some embodiments, the modified form of the Cas9/Csn1 polypeptide is a D10A (aspartate to alanine at amino acid position 10 of SEQ ID NO:8) mutation (or the corresponding mutation of any of the proteins presented in SEQ ID NOs:1-256 and 795-1346) that can cleave the complementary strand of the target DNA but has reduced ability to cleave the non-complementary strand of the target DNA (see FIG. 11A-11B). In some embodiments, the modified form of the Cas9/Csn1 polypeptide is a H840A (histidine to alanine at amino acid position 840) mutation (or the corresponding mutation of any of the proteins set forth as SEQ ID NOs: 1-256 and 795-1346) that can cleave the non-complementary strand of the target DNA but has reduced ability to cleave the complementary strand of the target DNA (see FIG. 11A-11B). In some embodiments, the modified form of the Cas9/Csn1 polypeptide harbors both the D10A and the H840A mutations (or the corresponding mutations of any of the proteins set forth as SEQ ID NOs:1-256 and 795-1346) such that the polypeptide has a reduced ability to cleave both the complementary and the non-complementary strands of the target DNA. Other residues can be mutated to achieve the above effects (i.e. inactivate one or the other nuclease portions). As non-limiting examples, residues D10, G12, G17, E762, H840, N854, N863, H982, H983, A984, D986, and/or A987 (or the corresponding mutations of any of the proteins set forth as SEQ ID NOs:1-256 and 795-1346) can be altered (i.e., substituted) (see FIGS. 3A-3B, FIG. 5, FIG. 11A, and Table 1 for more information regarding the conservation of Cas9 amino acid residues). Also, mutations other than alanine substitutions are suitable. For more information of important

TABLE 1

Table 1 lists 4 motifs that are present in Cas9 sequences from various species (see also FIG. 3A-3B and FIG. 5). The amino acids listed here arefrom the Cas9 from S. pyogenes (SEQ ID NO: 8).

| Motif # | Motif | Amino acids (residue #s) | Highly conserved |
|---|---|---|---|
| 1 | RuvC-like I | IGLDIGTNSVGWAVI (7-21) (SEQ ID NO: 260) | D10, G12, G17 |
| 2 | RuvC-like II | IVIEMARE (759-766) (SEQ ID NO: 261) | E762 |
| 3 | HNH-motif | DVDHIVPQSFLKDDSIDNKVLTR SDKN (837-863) (SEQ ID NO: 262) | H840, N854, N863 |
| 4 | RuvC-like II | HHAHDAYL (982-989) (SEQ ID NO: 263) | H982, H983, A984, D986, A987 |

In some cases, the chimeric site-directed modifying polypeptide comprises an amino acid sequence having at least about 75%, at least about 80%, at least about 85%, at least about 90%, at least about 95%, at least about 99% or 100% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346. In some cases, the chimeric site-directed modifying polypeptide comprises 4 motifs (as listed in Table 4 and depicted in FIG. 3A and FIG. 5), each with amino acid sequences having at least about 75%, at least about 80%, at least about 85%, at least about 90%, at least about 95%, at least about 99% or 100% amino acid sequence identity to each of the 4 motifs listed in Table 1(SEQ ID NOs:260-263), or to the corresponding portions in any of the amino acid sequences set forth as SEQ ID NOs:1-256 and 795-1346. In some cases, the chimeric site-directed modifying polypeptide comprises amino acid sequences having at least about 75%, at least about 80%, at least about 85%, at least about 90%, at least about 95%, at least about 99% or 100% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346.

In some embodiments, the activity portion of the site-directed modifying polypeptide comprises a heterologous polypeptide that has DNA-modifying activity and/or transcription factor activity and/or DNA-associated polypeptide-modifying activity. In some cases, a heterologous polypeptide replaces a portion of the Cas9/Csn1 polypeptide that provides nuclease activity. In other embodiments, a subject site-directed modifying polypeptide comprises both a portion of the Cas9/Csn1 polypeptide that normally provides nuclease activity (and that portion can be fully active or can instead be modified to have less than 100% of the corresponding wild-type activity) and a heterologous polypeptide. In other words, in some cases, a subject chimeric site-directed modifying polypeptide is a fusion polypeptide comprising both the portion of the Cas9/Csn1 polypeptide that normally provides nuclease activity and the heterologous polypeptide. In other cases, a subject chimeric site-directed modifying polypeptide is a fusion polypeptide comprising a modified variant of the activity portion of the Cas9/Csn1 polypeptide (e.g., amino acid change, deletion, insertion) and a heterologous polypeptide. In yet other cases, a subject chimeric site-directed modifying polypeptide is a fusion polypeptide comprising a heterologous polypeptide and the RNA-binding portion of a naturally-occurring or a modified site-directed modifying polypeptide.

For example, in a chimeric Cas9/Csn1 protein, a naturally-occurring (or modified, e.g., mutation, deletion, insertion) bacterial Cas9/Csn1 polypeptide may be fused to a heterologous polypeptide sequence (i.e. a polypeptide sequence from a protein other than Cas9/Csn1 or a polypeptide sequence from another organism). The heterologous polypeptide sequence may exhibit an activity (e.g., enzymatic activity) that will also be exhibited by the chimeric Cas9/Csn1 protein (e.g., methyltransferase activity, acetyltransferase activity, kinase activity, ubiquitinating activity, etc.). A heterologous nucleic acid sequence may be linked to another nucleic acid sequence (e.g., by genetic engineering) to generate a chimeric nucleotide sequence encoding a chimeric polypeptide. In some embodiments, a chimeric Cas9/Csn1 polypeptide is generated by fusing a Cas9/Csn1 polypeptide (e.g., wild type Cas9 or a Cas9 variant, e.g., a Cas9 with reduced or inactivated nuclease activity) with a heterologous sequence that provides for subcellular localization (e.g., a nuclear localization signal (NLS) for targeting to the nucleus; a mitochondrial localization signal for targeting to the mitochondria; a chloroplast localization signal for targeting to a chloroplast; an ER retention signal; and the like). In some embodiments, the heterologous sequence can provide a tag for ease of tracking or purification (e.g., a fluorescent protein, e.g., green fluorescent protein (GFP), YFP, RFP, CFP, mCherry, tdTomato, and the like; a HIS tag, e.g., a 6×His tag; a hemagglutinin (HA) tag; a FLAG tag; a Myc tag; and the like). In some embodiments, the heterologous sequence can provide for increased or decreased stability. In some embodiments, the heterologous sequence can provide a binding domain (e.g., to provide the ability of a chimeric Cas9 polypeptide to bind to another protein of interest, e.g., a DNA or histone modifying protein, a transcription factor or transcription repressor, a recruiting protein, etc.).

Examples of various additional suitable fusion partners (or fragments thereof) for a subject variant Cas9 site-directed polypeptide include, but are not limited to those listed in FIG. 54A-54C.

Nucleic Acid Encoding a Subject Chimeric Site-Directed Modifying Polypeptide

The present disclosure provides a nucleic acid comprising a nucleotide sequence encoding a subject chimeric site-directed modifying polypeptide. In some embodiments, the nucleic acid comprising a nucleotide sequence encoding a subject chimeric site-directed modifying polypeptide is an expression vector, e.g., a recombinant expression vector.

In some embodiments, a subject method involves contacting a target DNA or introducing into a cell (or a population of cells) one or more nucleic acids comprising a chimeric site-directed modifying polypeptide. Suitable nucleic acids comprising nucleotide sequences encoding a chimeric site-directed modifying polypeptide include expression vectors, where an expression vector comprising a nucleotide sequence encoding a chimeric site-directed modifying polypeptide is a "recombinant expression vector."

In some embodiments, the recombinant expression vector is a viral construct, e.g., a recombinant adeno-associated virus construct (see, e.g., U.S. Pat. No. 7,078,387), a recombinant adenoviral construct, a recombinant lentiviral construct, etc.

Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like.

Numerous suitable expression vectors are known to those of skill in the art, and many are commercially available. The following vectors are provided by way of example; for eukaryotic host cells: pXT1, pSG5 (Stratagene), pSVK3, pBPV, pMSG, and pSVLSV40 (Pharmacia). However, any other vector may be used so long as it is compatible with the host cell.

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology,* 153:516-544).

In some embodiments, a nucleotide sequence encoding a chimeric site-directed modifying polypeptide is operably linked to a control element, e.g., a transcriptional control element, such as a promoter. The transcriptional control element may be functional in either a eukaryotic cell, e.g., a mammalian cell; or a prokaryotic cell (e.g., bacterial or archaeal cell). In some embodiments, a nucleotide sequence encoding a chimeric site-directed modifying polypeptide is operably linked to multiple control elements that allow expression of the nucleotide sequence encoding a chimeric site-directed modifying polypeptide in both prokaryotic and eukaryotic cells.

Non-limiting examples of suitable eukaryotic promoters (promoters functional in a eukaryotic cell) include those from cytomegalovirus (CMV) immediate early, herpes simplex virus (HSV) thymidine kinase, early and late SV40, long terminal repeats (LTRs) from retrovirus, and mouse metallothionein-I. Selection of the appropriate vector and promoter is well within the level of ordinary skill in the art. The expression vector may also contain a ribosome binding site for translation initiation and a transcription terminator. The expression vector may also include appropriate sequences for amplifying expression. The expression vector may also include nucleotide sequences encoding protein tags (e.g., 6xHis tag, hemagglutinin (HA) tag, a fluorescent protein (e.g., a green fluorescent protein; a yellow fluorescent protein, etc.), etc.) that are fused to the chimeric site-directed modifying polypeptide.

In some embodiments, a nucleotide sequence encoding a chimeric site-directed modifying polypeptide is operably linked to an inducible promoter (e.g., heat shock promoter, Tetracycline-regulated promoter, Steroid-regulated promoter, Metal-regulated promoter, estrogen receptor-regulated promoter, etc.). In some embodiments, a nucleotide sequence encoding a chimeric site-directed modifying polypeptide is operably linked to a spatially restricted and/or temporally restricted promoter (e.g., a tissue specific promoter, a cell type specific promoter, etc.). In some embodiments, a nucleotide sequence encoding a chimeric site-directed modifying polypeptide is operably linked to a constitutive promoter.

Methods of introducing a nucleic acid into a host cell are known in the art, and any known method can be used to introduce a nucleic acid (e.g., an expression construct) into a stem cell or progenitor cell. Suitable methods include, include e.g., viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et., al Adv Drug Deliv Rev. 2012 Sep. 13. pii: S0169-409X(12)00283-9. doi: 10.1016/j.addr.2012.09.023), and the like.

Methods

The present disclosure provides methods for modifying a target DNA and/or a target DNA-associated polypeptide. Generally, a subject method involves contacting a target DNA with a complex (a "targeting complex"), which complex comprises a DNA-targeting RNA and a site-directed modifying polypeptide.

As discussed above, a subject DNA-targeting RNA and a subject site-directed modifying polypeptide form a complex. The DNA-targeting RNA provides target specificity to the complex by comprising a nucleotide sequence that is complementary to a sequence of a target DNA. The site-directed modifying polypeptide of the complex provides the site-specific activity. In some embodiments, a subject complex modifies a target DNA, leading to, for example, DNA cleavage, DNA methylation, DNA damage, DNA repair, etc. In other embodiments, a subject complex modifies a target polypeptide associated with target DNA (e.g., a histone, a DNA-binding protein, etc.), leading to, for example, histone methylation, histone acetylation, histone ubiquitination, and the like. The target DNA may be, for example, naked DNA in vitro, chromosomal DNA in cells in vitro, chromosomal DNA in cells in vivo, etc.

In some cases, the site-directed modifying polypeptide exhibits nuclease activity that cleaves target DNA at a target DNA sequence defined by the region of complementarity between the DNA-targeting RNA and the target DNA. In some cases, when the site-directed modifying polypeptide is a Cas9 or Cas9 related polypeptide, site-specific cleavage of the target DNA occurs at locations determined by both (i) base-pairing complementarity between the DNA-targeting RNA and the target DNA; and (ii) a short motif [referred to as the protospacer adjacent motif (PAM)] in the target DNA. In some embodiments (e.g., when Cas9 from *S. pyogenes*, or a closely related Cas9, is used (see SEQ ID NOs:1-256 and 795-1346)), the PAM sequence of the non-complementary strand is 5'-XGG-3', where X is any DNA nucleotide and X is immediately 3' of the target sequence of the non-complementary strand of the target DNA (see FIG. 10A-10E). As such, the PAM sequence of the complementary strand is 5'-CCY-3', where Y is any DNA nucleotide and Y is immediately 5' of the target sequence of the complementary strand of the target DNA (see FIG. 10A-10E where the PAM of the non-complementary strand is 5'-GGG-3' and the PAM of the complementary strand is 5'-CCC-3'). In some such embodiments, X and Y can be complementary and the X-Y base pair can be any basepair (e.g., X=C and Y=G; X=G and Y=C; X=A and Y=T, X=T and Y=A).

In some cases, different Cas9 proteins (i.e., Cas9 proteins from various species) may be advantageous to use in the various provided methods in order to capitalize on various enzymatic characteristics of the different Cas9 proteins (e.g., for different PAM sequence preferences; for increased or decreased enzymatic activity; for an increased or decreased level of cellular toxicity; to change the balance between NHEJ, homology-directed repair, single strand breaks, double strand breaks, etc.). Cas9 proteins from various species (see SEQ ID NOs:1-256 and 795-1346) may require different PAM sequences in the target DNA. Thus, for a particular Cas9 protein of choice, the PAM sequence requirement may be different than the 5'-XGG-3' sequence described above.

Many Cas9 orthologus from a wide variety of species have been identified herein and the proteins share only a few identical amino acids. All identified Cas9 orthologs have the same domain architecture with a central HNH endonuclease domain and a split RuvC/RNaseH domain (See FIG. 3A, FIG. 3B, FIG. 5, and Table 1). Cas9 proteins share 4 key motifs with a conserved architecture. Motifs 1, 2, and 4 are RuvC like motifs while motif 3 is an HNH-motif. In some cases, a suitable site-directed modifying polypeptide comprises an amino acid sequence having 4 motifs, each of motifs 1-4 having at least about 75%, at least about 80%, at least about 85%, at least about 90%, at least about 95%, at least about 99% or 100% amino acid sequence identity to the motifs 1-4 of the Cas9/Csn1 amino acid sequence depicted in FIG. 3A (SEQ ID NOs:260-263, respectively, as depicted in Table 1), or to the corresponding portions in any of the amino acid sequences set forth in SEQ ID NOs:1-256 and 795-1346 (see FIG. 5 for an alignment of motifs 1-4 from divergent Cas9 sequences). In some cases, a suitable site-directed modifying polypeptide comprises an amino acid sequence having at least about 75%, at least about 80%, at least about 85%, at least about 90%, at least about 95%, at least about 99% or 100% amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346. Any Cas9 protein as defined above can be used as a site-directed modifying polypeptide or as part of a chimeric site-directed modifying polypeptide of the subject methods.

Figure 2:
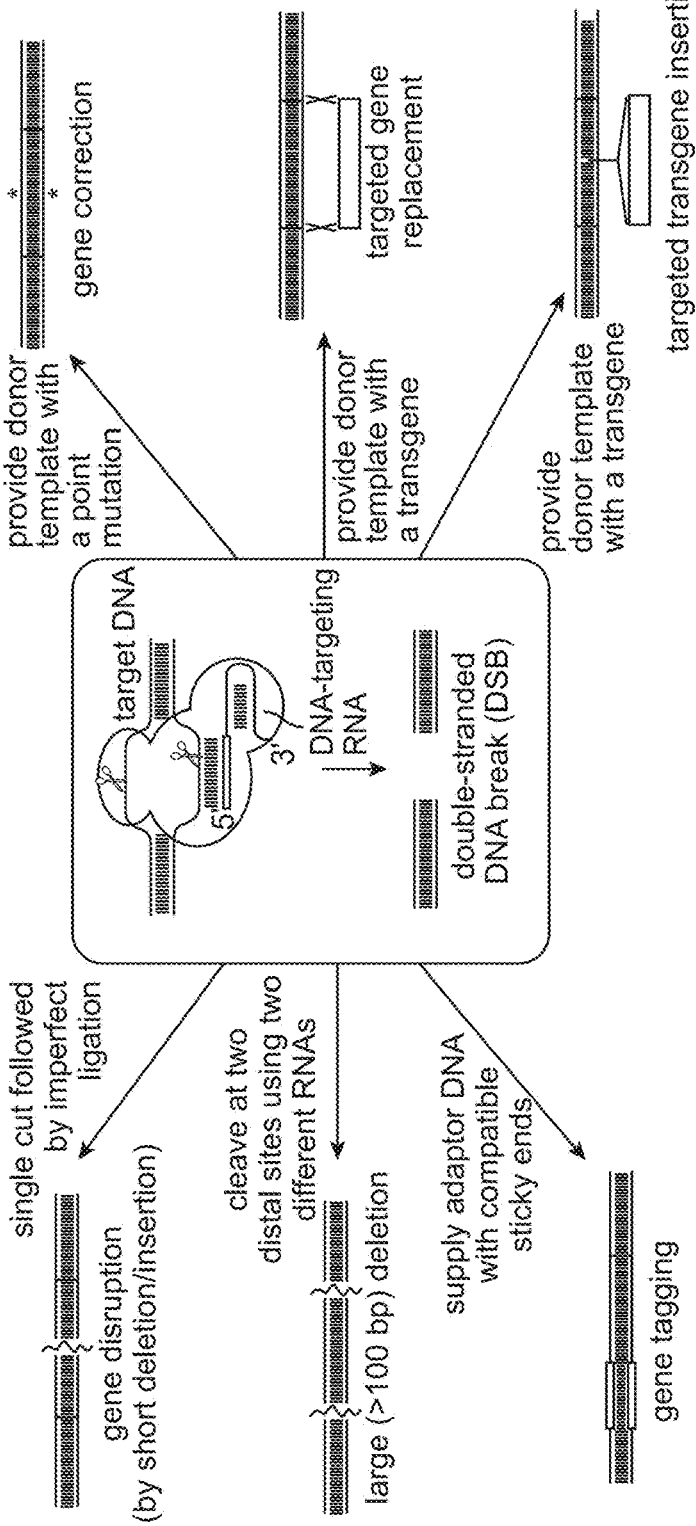
FIG. 2 depicts target DNA editing through double-stranded DNA breaks introduced using a Cas9/Csn1 site-directed modifying polypeptide and a DNA-targeting RNA.

The nuclease activity cleaves target DNA to produce double strand breaks. These breaks are then repaired by the cell in one of two ways: non-homologous end joining, and homology-directed repair (FIG. 2). In non-homologous end joining (NHEJ), the double-strand breaks are repaired by direct ligation of the break ends to one another. As such, no new nucleic acid material is inserted into the site, although some nucleic acid material may be lost, resulting in a deletion. In homology-directed repair, a donor polynucleotide with homology to the cleaved target DNA sequence is used as a template for repair of the cleaved target DNA sequence, resulting in the transfer of genetic information from the donor polynucleotide to the target DNA. As such, new nucleic acid material may be inserted/copied into the site. In some cases, a target DNA is contacted with a subject donor polynucleotide. In some cases, a subject donor polynucleotide is introduced into a subject cell. The modifications of the target DNA due to NHEJ and/or homology-directed repair lead to, for example, gene correction, gene replacement, gene tagging, transgene insertion, nucleotide deletion, gene disruption, gene mutation, etc.

Accordingly, cleavage of DNA by a site-directed modifying polypeptide may be used to delete nucleic acid material from a target DNA sequence (e.g., to disrupt a gene that makes cells susceptible to infection (e.g. the CCR5 or CXCR4 gene, which makes T cells susceptible to HIV infection), to remove disease-causing trinucleotide repeat sequences in neurons, to create gene knockouts and mutations as disease models in research, etc.) by cleaving the target DNA sequence and allowing the cell to repair the sequence in the absence of an exogenously provided donor polynucleotide. Thus, the subject methods can be used to knock out a gene (resulting in complete lack of transcription or altered transcription) or to knock in genetic material into a locus of choice in the target DNA.

Alternatively, if a DNA-targeting RNA and a site-directed modifying polypeptide are coadministered to cells with a donor polynucleotide sequence that includes at least a segment with homology to the target DNA sequence, the subject methods may be used to add, i.e. insert or replace, nucleic acid material to a target DNA sequence (e.g. to "knock in" a nucleic acid that encodes for a protein, an siRNA, an miRNA, etc.), to add a tag (e.g., 6xHis, a fluorescent protein (e.g., a green fluorescent protein; a yellow fluorescent protein, etc.), hemagglutinin (HA), FLAG, etc.), to add a regulatory sequence to a gene (e.g. promoter, polyadenylation signal, internal ribosome entry sequence (IRES), 2A peptide, start codon, stop codon, splice signal, localization signal, etc.), to modify a nucleic acid sequence (e.g., introduce a mutation), and the like. As such, a complex comprising a DNA-targeting RNA and a site-directed modifying polypeptide is useful in any in vitro or in vivo application in which it is desirable to modify DNA in a site-specific, i.e. "targeted", way, for example gene knockout, gene knock-in, gene editing, gene tagging, etc., as used in, for example, gene therapy, e.g. to treat a disease or as an antiviral, antipathogenic, or anticancer therapeutic, the production of genetically modified organisms in agriculture, the large scale production of proteins by cells for therapeutic, diagnostic, or research purposes, the induction of iPS cells, biological research, the targeting of genes of pathogens for deletion or replacement, etc.

In some embodiments, the site-directed modifying polypeptide comprises a modified form of the Cas9/Csn1 protein. In some instances, the modified form of the Cas9/Csn1 protein comprises an amino acid change (e.g., deletion, insertion, or substitution) that reduces the naturally-occurring nuclease activity of the Cas9/Csn1 protein. For example, in some instances, the modified form of the Cas9/Csn1 protein has less than 50%, less than 40%, less than 30%, less than 20%, less than 10%, less than 5%, or less than 1% of the nuclease activity of the corresponding wild-type Cas9/Csn1 polypeptide. In some cases, the modified form of the Cas9/Csn1 polypeptide has no substantial nuclease activity. When a subject site-directed modifying polypeptide is a modified form of the Cas9/Csn1 polypeptide that has no substantial nuclease activity, it can be referred to as "dCas9."

In some embodiments, the modified form of the Cas9/Csn1 polypeptide is a D10A (aspartate to alanine at amino acid position 10 of SEQ ID NO:8) mutation (or the corresponding mutation of any of the proteins set forth as SEQ ID NOs:1-256 and 795-1346) that can cleave the complementary strand of the target DNA but has reduced ability to cleave the non-complementary strand of the target DNA (thus resulting in a single strand break (SSB) instead of a DSB; see FIG. 11A-11B). In some embodiments, the modified form of the Cas9/Csn1 polypeptide is a H840A (histidine to alanine at amino acid position 840 of SEQ ID NO:8) mutation (or the corresponding mutation of any of the proteins set forth as SEQ ID NOs:1-256 and 795-1346) that can cleave the non-complementary strand of the target DNA but has reduced ability to cleave the complementary strand of the target DNA (thus resulting in a single strand break (SSB) instead of a DSB; see FIG. 11A-11B). The use of the D10A or H840A variant of Cas9 (or the corresponding mutations in any of the proteins set forth as SEQ ID NOs:1-256 and 795-1346) can alter the expected biological outcome because the non-homologous end joining (NHEJ) is much more likely to occur when DSBs are present as opposed to SSBs. Thus, in some cases where one wishes to reduce the likelihood of DSB (and therefore reduce the likelihood of NHEJ), a D10A or H840A variant of Cas9 can be used. Other residues can be mutated to achieve the same effect (i.e. inactivate one or the other nuclease portions). As non-limiting examples, residues D10, G12, G17, E762, H840, N854, N863, H982, H983, A984, D986, and/or A987 (or the corresponding mutations of any of the proteins set forth as SEQ ID NOs:1-256 and 795-1346) can be altered (i.e., substituted) (see FIG. 3A-3B, FIG. 5, FIG. 11A, and Table 1 for more information regarding the conservation of Cas9 amino acid residues). Also, mutations other than alanine substitutions are suitable. In some embodiments when a site-directed polypeptide (e.g., site-directed modifying polypeptide) has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), the polypeptide can still bind to target DNA in a site-specific manner (because it is still guided to a target DNA sequence by a DNA-targeting RNA) as long as it retains the ability to interact with the DNA-targeting RNA.

In some embodiments, the modified form of the Cas9/Csn1 polypeptide harbors both the D10A and the H840A mutations (or the corresponding mutations of any of the proteins set forth as SEQ ID NOs:1-256 and 795-1346) such that the polypeptide has a reduced ability to cleave both the complementary and the non-complementary strands of the target DNA (i.e., the variant can have no substantial nuclease activity). Other residues can be mutated to achieve the same effect (i.e. inactivate one or the other nuclease portions). As non-limiting examples, residues D10, G12, G17, E762, H840, N854, N863, H982, H983, A984, D986, and/or A987 (or the corresponding mutations of any of the proteins set forth as SEQ ID NOs:1-256 and 795-1346) can be altered (i.e., substituted) (see FIG. 3A-3B, FIG. 5, FIG. 11A, and Table 1 for more information regarding the conservation of Cas9 amino acid residues). Also, mutations other than alanine substitutions are suitable.

In some embodiments, the site-directed modifying polypeptide comprises a heterologous sequence (e.g., a fusion). In some embodiments, a heterologous sequence can provide for subcellular localization of the site-directed modifying polypeptide (e.g., a nuclear localization signal (NLS) for targeting to the nucleus; a mitochondrial localization signal for targeting to the mitochondria; a chloroplast localization signal for targeting to a chloroplast; a ER retention signal; and the like). In some embodiments, a heterologous sequence can provide a tag for ease of tracking or purification (e.g., a fluorescent protein, e.g., green fluorescent protein (GFP), YFP, RFP, CFP, mCherry, tdTomato, and the like; a his tag, e.g., a 6×His tag; a hemagglutinin (HA) tag; a FLAG tag; a Myc tag; and the like). In some embodiments, the heterologous sequence can provide for increased or decreased stability.

In some embodiments, a subject site-directed modifying polypeptide can be codon-optimized. This type of optimization is known in the art and entails the mutation of foreign-derived DNA to mimic the codon preferences of the intended host organism or cell while encoding the same protein. Thus, the codons are changed, but the encoded protein remains unchanged. For example, if the intended target cell was a human cell, a human codon-optimized Cas9 (or variant, e.g., enzymatically inactive variant) would be a suitable site-directed modifying polypeptide (see SEQ ID NO:256 for an example). Any suitable site-directed modifying polypeptide (e.g., any Cas9 such as any of the sequences set forth in SEQ ID NOs:1-256 and 795-1346) can be codon optimized. As another non-limiting example, if the intended host cell were a mouse cell, than a mouse codon-optimized Cas9 (or variant, e.g., enzymatically inactive variant) would be a suitable site-directed modifying polypeptide. While codon optimization is not required, it is acceptable and may be preferable in certain cases.

In some embodiments, a subject DNA-targeting RNA and a subject site-directed modifying polypeptide are used as an inducible system for shutting off gene expression in bacterial cells. In some cases, nucleic acids encoding an appropriate DNA-targeting RNA and/or an appropriate site-directed polypeptide are incorporated into the chromosome of a target cell and are under control of an inducible promoter. When the DNA-targeting RNA and/or the site-directed polypeptide are induced, the target DNA is cleaved (or otherwise modified) at the location of interest (e.g., a target gene on a separate plasmid), when both the DNA-targeting RNA and the site-directed modifying polypeptide are present and form a complex. As such, in some cases, bacterial expression strains are engineered to include nucleic acid sequences encoding an appropriate site-directed modifying polypeptide in the bacterial genome and/or an appropriate DNA-targeting RNA on a plasmid (e.g., under control of an inducible promoter), allowing experiments in which the expression of any targeted gene (expressed from a separate plasmid introduced into the strain) could be controlled by inducing expression of the DNA-targeting RNA and the site-directed polypeptide.

In some cases, the site-directed modifying polypeptide has enzymatic activity that modifies target DNA in ways other than introducing double strand breaks. Enzymatic activity of interest that may be used to modify target DNA (e.g., by fusing a heterologous polypeptide with enzymatic activity to a site-directed modifying polypeptide, thereby generating a chimeric site-directed modifying polypeptide) includes, but is not limited methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity). Methylation and demethylation is recognized in the art as an important mode of epigenetic gene regulation while DNA damage and repair activity is essential for cell survival and for proper genome maintenance in response to environmental stresses.

As such, the methods herein find use in the epigenetic modification of target DNA and may be employed to control epigenetic modification of target DNA at any location in a target DNA by genetically engineering the desired complementary nucleic acid sequence into the DNA-targeting segment of a DNA-targeting RNA. The methods herein also find use in the intentional and controlled damage of DNA at any desired location within the target DNA. The methods herein also find use in the sequence-specific and controlled repair of DNA at any desired location within the target DNA. Methods to target DNA-modifying enzymatic activities to specific locations in target DNA find use in both research and clinical applications.

In some cases, the site-directed modifying polypeptide has activity that modulates the transcription of target DNA (e.g., in the case of a chimeric site-directed modifying polypeptide, etc.). In some cases, a chimeric site-directed modifying polypeptides comprising a heterologous polypeptide that exhibits the ability to increase or decrease transcription (e.g., transcriptional activator or transcription repressor polypeptides) is used to increase or decrease the transcription of target DNA at a specific location in a target DNA, which is guided by the DNA-targeting segment of the DNA-targeting RNA. Examples of source polypeptides for providing a chimeric site-directed modifying polypeptide with transcription modulatory activity include, but are not limited to light-inducible transcription regulators, small molecule/drug-responsive transcription regulators, transcription factors, transcription repressors, etc. In some cases, the subject method is used to control the expression of a targeted coding-RNA (protein-encoding gene) and/or a targeted non-coding RNA (e.g., tRNA, rRNA, snoRNA, siRNA, miRNA, long ncRNA, etc.).

In some cases, the site-directed modifying polypeptide has enzymatic activity that modifies a polypeptide associated with DNA (e.g. histone). In some embodiments, the enzymatic activity is methyltransferase activity, demethylase activity, acetyltransferase activity, deacetylase activity, kinase activity, phosphatase activity, ubiquitin ligase activity (i.e., ubiquitination activity), deubiquitinating activity, adenylation activity, deadenylation activity, SUMOylating activity, deSUMOylating activity, ribosylation activity, deribosylation activity, myristoylation activity, demyristoylation activity glycosylation activity (e.g., from O-GlcNAc transferase) or deglycosylation activity. The enzymatic activities listed herein catalyze covalent modifications to proteins. Such modifications are known in the art to alter the stability or activity of the target protein (e.g., phosphorylation due to kinase activity can stimulate or silence protein activity depending on the target protein). Of particular interest as protein targets are histones. Histone proteins are known in the art to bind DNA and form complexes known as nucleosomes. Histones can be modified (e.g., by methylation, acetylation, ubuitination, phosphorylation) to elicit structural changes in the surrounding DNA, thus controlling the accessibility of potentially large portions of DNA to interacting factors such as transcription factors, polymerases and the like. A single histone can be modified in many different ways and in many different combinations (e.g., trimethylation of lysine 27 of histone 3, H3K27, is associated with DNA regions of repressed transcription while trimethylation of lysine 4 of histone 3, H3K4, is associated with DNA regions of active transcription). Thus, a site-directed modifying polypeptide with histone-modifying activity finds use in the site specific control of DNA structure and can be used to alter the histone modification pattern in a selected region of target DNA. Such methods find use in both research and clinical applications.

In some embodiments, multiple DNA-targeting RNAs are used simultaneously to simultaneously modify different locations on the same target DNA or on different target DNAs. In some embodiments, two or more DNA-targeting RNAs target the same gene or transcript or locus. In some embodiments, two or more DNA-targeting RNAs target different unrelated loci. In some embodiments, two or more DNA-targeting RNAs target different, but related loci.

In some cases, the site-directed modifying polypeptide is provided directly as a protein. As one non-limiting example, fungi (e.g., yeast) can be transformed with exogenous protein and/or nucleic acid using spheroplast transformation (see Kawai et al., Bioeng Bugs. 2010 November-December; 1(6):395-403: "Transformation of *Saccharomyces cerevisiae* and other fungi: methods and possible underlying mechanism"; and Tanka et al., Nature. 2004 Mar. 18; 428 (6980):323-8: "Conformational variations in an infectious protein determine prion strain differences"; both of which are herein incorporated by reference in their entirety). Thus, a site-directed modifying polypeptide (e.g., Cas9) can be incorporated into a spheroplast (with or without nucleic acid encoding a DNA-targeting RNA and with or without a donor polynucleotide) and the spheroplast can be used to introduce the content into a yeast cell. A site-directed modifying polypeptide can be introduced into a cell (provided to the cell) by any convenient method; such methods are known to those of ordinary skill in the art. As another non-limiting example, a site-directed modifying polypeptide can be injected directly into a cell (e.g., with or without nucleic acid encoding a DNA-targeting RNA and with or without a donor polynucleotide), e.g., a cell of a zebrafish embryo, the pronucleus of a fertilized mouse oocyte, etc.

Target Cells of Interest

In some of the above applications, the subject methods may be employed to induce DNA cleavage, DNA modification, and/or transcriptional modulation in mitotic or post-mitotic cells in vivo and/or ex vivo and/or in vitro (e.g., to produce genetically modified cells that can be reintroduced into an individual). Because the DNA-targeting RNA provide specificity by hybridizing to target DNA, a mitotic and/or post-mitotic cell of interest in the disclosed methods may include a cell from any organism (e.g. a bacterial cell, an archaeal cell, a cell of a single-cell eukaryotic organism, a plant cell, an algal cell, e.g., *Botryococcus braunii, Chlamydomonas reinhardtii, Nannochloropsis gaditana, Chlorella pyrenoidosa, Sargassum patens C. Agardh*, and the like, a fungal cell (e.g., a yeast cell), an animal cell, a cell from an invertebrate animal (e.g. fruit fly, cnidarian, echinoderm, nematode, etc.), a cell from a vertebrate animal (e.g., fish, amphibian, reptile, bird, mammal), a cell from a mammal, a cell from a rodent, a cell from a human, etc.).

Any type of cell may be of interest (e.g. a stem cell, e.g. an embryonic stem (ES) cell, an induced pluripotent stem (iPS) cell, a germ cell; a somatic cell, e.g. a fibroblast, a hematopoietic cell, a neuron, a muscle cell, a bone cell, a hepatocyte, a pancreatic cell; an in vitro or in vivo embryonic cell of an embryo at any stage, e.g., a 1-cell, 2-cell, 4-cell, 8-cell, etc. stage zebrafish embryo; etc.). Cells may be from established cell lines or they may be primary cells, where "primary cells", "primary cell lines", and "primary cultures" are used interchangeably herein to refer to cells and cells cultures that have been derived from a subject and allowed to grow in vitro for a limited number of passages, i.e. splittings, of the culture. For example, primary cultures are cultures that may have been passaged 0 times, 1 time, 2 times, 4 times, 5 times, 10 times, or 15 times, but not enough times go through the crisis stage. Typically, the primary cell lines of the present invention are maintained for fewer than 10 passages in vitro. Target cells are in many embodiments unicellular organisms, or are grown in culture.

If the cells are primary cells, they may be harvest from an individual by any convenient method. For example, leukocytes may be conveniently harvested by apheresis, leukocytapheresis, density gradient separation, etc., while cells from tissues such as skin, muscle, bone marrow, spleen, liver, pancreas, lung, intestine, stomach, etc. are most conveniently harvested by biopsy. An appropriate solution may be used for dispersion or suspension of the harvested cells. Such solution will generally be a balanced salt solution, e.g. normal saline, phosphate-buffered saline (PBS), Hank's balanced salt solution, etc., conveniently supplemented with fetal calf serum or other naturally occurring factors, in conjunction with an acceptable buffer at low concentration, generally from 5-25 mM. Convenient buffers include HEPES, phosphate buffers, lactate buffers, etc. The cells may be used immediately, or they may be stored, frozen, for long periods of time, being thawed and capable of being reused. In such cases, the cells will usually be frozen in 10% DMSO, 50% serum, 40% buffered medium, or some other such solution as is commonly used in the art to preserve cells at such freezing temperatures, and thawed in a manner as commonly known in the art for thawing frozen cultured cells.

Nucleic Acids Encoding a Subject DNA-Targeting RNA and/or a Subject Site-Directed Modifying Polypeptide In some embodiments, a subject method involves contacting a target DNA or introducing into a cell (or a population of cells) one or more nucleic acids comprising nucleotide sequences encoding a DNA-targeting RNA and/or a site-directed modifying polypeptide and/or a donor polynucleotide. Suitable nucleic acids comprising nucleotide sequences encoding a DNA-targeting RNA and/or a site-directed modifying polypeptide include expression vectors, where an expression vector comprising a nucleotide sequence encoding a DNA-targeting RNA and/or a site-directed modifying polypeptide is a "recombinant expression vector."

In some embodiments, the recombinant expression vector is a viral construct, e.g., a recombinant adeno-associated virus construct (see, e.g., U.S. Pat. No. 7,078,387), a recombinant adenoviral construct, a recombinant lentiviral construct, etc.

Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like.

Numerous suitable expression vectors are known to those of skill in the art, and many are commercially available. The following vectors are provided by way of example; for eukaryotic host cells: pXT1, pSG5 (Stratagene), pSVK3, pBPV, pMSG, and pSVLSV40 (Pharmacia). However, any other vector may be used so long as it is compatible with the host cell.

In some embodiments, a nucleotide sequence encoding a DNA-targeting RNA and/or a site-directed modifying polypeptide is operably linked to a control element, e.g., a transcriptional control element, such as a promoter. The transcriptional control element may be functional in either a eukaryotic cell, e.g., a mammalian cell, or a prokaryotic cell (e.g., bacterial or archaeal cell). In some embodiments, a nucleotide sequence encoding a DNA-targeting RNA and/or a site-directed modifying polypeptide is operably linked to multiple control elements that allow expression of the nucleotide sequence encoding a DNA-targeting RNA and/or a site-directed modifying polypeptide in both prokaryotic and eukaryotic cells.

Depending on the host/vector system utilized, any of a number of suitable transcription and translation control elements, including constitutive and inducible promoters, transcription enhancer elements, transcription terminators, etc. may be used in the expression vector (e.g., U6 promoter, H1 promoter, etc.; see above) (see e.g., Bitter et al. (1987) *Methods in Enzymology*, 153:516-544).

In some embodiments, a DNA-targeting RNA and/or a site-directed modifying polypeptide can be provided as RNA. In such cases, the DNA-targeting RNA and/or the RNA encoding the site-directed modifying polypeptide can be produced by direct chemical synthesis or may be transcribed in vitro from a DNA encoding the DNA-targeting RNA. Methods of synthesizing RNA from a DNA template are well known in the art. In some cases, the DNA-targeting RNA and/or the RNA encoding the site-directed modifying polypeptide will be synthesized in vitro using an RNA polymerase enzyme (e.g., T7 polymerase, T3 polymerase, SP6 polymerase, etc.). Once synthesized, the RNA may directly contact a target DNA or may be introduced into a cell by any of the well-known techniques for introducing nucleic acids into cells (e.g., microinjection, electroporation, transfection, etc).

Nucleotides encoding a DNA-targeting RNA (introduced either as DNA or RNA) and/or a site-directed modifying polypeptide (introduced as DNA or RNA) and/or a donor polynucleotide may be provided to the cells using well-developed transfection techniques; see, e.g. Angel and Yanik (2010) PLoS ONE 5(7): e11756, and the commercially available TransMessenger® reagents from Qiagen, Stemfect™ RNA Transfection Kit from Stemgent, and TransIT®-mRNA Transfection Kit from Mirus Bio LLC. See also Beumer et al. (2008) Efficient gene targeting in *Drosophila* by direct embryo injection with zinc-finger nucleases. PNAS 105(50):19821-19826. Alternatively, nucleic acids encoding a DNA-targeting RNA and/or a site-directed modifying polypeptide and/or a chimeric site-directed modifying polypeptide and/or a donor polynucleotide may be provided on DNA vectors. Many vectors, e.g. plasmids, cosmids, minicircles, phage, viruses, etc., useful for transferring nucleic acids into target cells are available. The vectors comprising the nucleic acid(s) may be maintained episomally, e.g. as plasmids, minicircle DNAs, viruses such cytomegalovirus, adenovirus, etc., or they may be integrated into the target cell genome, through homologous recombination or random integration, e.g. retrovirus-derived vectors such as MMLV, HIV-1, ALV, etc.

Vectors may be provided directly to the subject cells. In other words, the cells are contacted with vectors comprising the nucleic acid encoding DNA-targeting RNA and/or a site-directed modifying polypeptide and/or a chimeric site-directed modifying polypeptide and/or a donor polynucleotide such that the vectors are taken up by the cells. Methods for contacting cells with nucleic acid vectors that are plasmids, including electroporation, calcium chloride transfection, microinjection, and lipofection are well known in the art. For viral vector delivery, the cells are contacted with viral particles comprising the nucleic acid encoding a DNA-targeting RNA and/or a site-directed modifying polypeptide and/or a chimeric site-directed modifying polypeptide and/or a donor polynucleotide. Retroviruses, for example, lentiviruses, are particularly suitable to the method of the invention. Commonly used retroviral vectors are "defective", i.e. unable to produce viral proteins required for productive infection. Rather, replication of the vector requires growth in a packaging cell line. To generate viral particles comprising nucleic acids of interest, the retroviral nucleic acids comprising the nucleic acid are packaged into viral capsids by a packaging cell line. Different packaging cell lines provide a different envelope protein (ecotropic, amphotropic or xenotropic) to be incorporated into the capsid, this envelope protein determining the specificity of the viral particle for the cells (ecotropic for murine and rat; amphotropic for most mammalian cell types including human, dog and mouse; and xenotropic for most mammalian cell types except murine cells). The appropriate packaging cell line may be used to ensure that the cells are targeted by the packaged viral particles. Methods of introducing the retroviral vectors comprising the nucleic acid encoding the reprogramming factors into packaging cell lines and of collecting the viral particles that are generated by the packaging lines are well known in the art. Nucleic acids can also introduced by direct micro-injection (e.g., injection of RNA into a zebrafish embryo).

Vectors used for providing the nucleic acids encoding DNA-targeting RNA and/or a site-directed modifying polypeptide and/or a chimeric site-directed modifying polypeptide and/or a donor polynucleotide to the subject cells will typically comprise suitable promoters for driving the expression, that is, transcriptional activation, of the nucleic acid of interest. In other words, the nucleic acid of interest will be operably linked to a promoter. This may include ubiquitously acting promoters, for example, the CMV-β-actin promoter, or inducible promoters, such as promoters that are active in particular cell populations or that respond to the presence of drugs such as tetracycline. By transcriptional activation, it is intended that transcription will be increased above basal levels in the target cell by at least about 10 fold, by at least about 100 fold, more usually by at least about 1000 fold. In addition, vectors used for providing a DNA-targeting RNA and/or a site-directed modifying polypeptide and/or a chimeric site-directed modifying polypeptide and/or a donor polynucleotide to the subject cells may include nucleic acid sequences that encode for selectable markers in the target cells, so as to identify cells that have taken up the DNA-targeting RNA and/or a site-directed modifying polypeptide and/or a chimeric site-directed modifying polypeptide and/or a donor polynucleotide.

A subject DNA-targeting RNA and/or a site-directed modifying polypeptide and/or a chimeric site-directed modifying polypeptide may instead be used to contact DNA or introduced into cells as RNA. Methods of introducing RNA into cells are known in the art and may include, for example, direct injection, transfection, or any other method used for the introduction of DNA.

A subject site-directed modifying polypeptide may instead be provided to cells as a polypeptide. Such a polypeptide may optionally be fused to a polypeptide domain that increases solubility of the product. The domain may be linked to the polypeptide through a defined protease cleavage site, e.g. a TEV sequence, which is cleaved by TEV protease. The linker may also include one or more flexible sequences, e.g. from 1 to 10 glycine residues. In some embodiments, the cleavage of the fusion protein is performed in a buffer that maintains solubility of the product, e.g. in the presence of from 0.5 to 2 M urea, in the presence of polypeptides and/or polynucleotides that increase solubility, and the like. Domains of interest include endosomolytic domains, e.g. influenza HA domain; and other polypeptides that aid in production, e.g. IF2 domain, GST domain, GRPE domain, and the like. The polypeptide may be formulated for improved stability. For example, the peptides may be PEGylated, where the polyethyleneoxy group provides for enhanced lifetime in the blood stream.

Additionally or alternatively, the subject site-directed modifying polypeptide may be fused to a polypeptide permeant domain to promote uptake by the cell. A number of permeant domains are known in the art and may be used in the non-integrating polypeptides of the present invention, including peptides, peptidomimetics, and non-peptide carriers. For example, a permeant peptide may be derived from the third alpha helix of *Drosophila melanogaster* transcription factor Antennapaedia, referred to as penetratin, which comprises the amino acid sequence RQIKIWFQNRRMKWKK (SEQ ID NO: 268). As another example, the permeant peptide comprises the HIV-1 tat basic region amino acid sequence, which may include, for example, amino acids 49-57 of naturally-occurring tat protein. Other permeant domains include polyarginine motifs, for example, the region of amino acids 34-56 of HIV-1 rev protein, nona-arginine, octa-arginine, and the like. (See, for example, Futaki et al. (2003) Curr Protein Pept Sci. 2003 April; 4(2): 87-9 and 446; and Wender et al. (2000) Proc. Natl. Acad. Sci. U.S.A 2000 Nov. 21; 97(24):13003-8; published U.S. Patent applications 20030220334; 20030083256; 20030032593; and 20030022831, herein specifically incorporated by reference for the teachings of translocation peptides and peptoids). The nona-arginine (R9) sequence is one of the more efficient PTDs that have been characterized (Wender et al. 2000; Uemura et al. 2002). The site at which the fusion is made may be selected in order to optimize the biological activity, secretion or binding characteristics of the polypeptide. The optimal site will be determined by routine experimentation.

A subject site-directed modifying polypeptide may be produced in vitro or by eukaryotic cells or by prokaryotic cells, and it may be further processed by unfolding, e.g. heat denaturation, DTT reduction, etc. and may be further refolded, using methods known in the art.

Modifications of interest that do not alter primary sequence include chemical derivatization of polypeptides, e.g., acylation, acetylation, carboxylation, amidation, etc. Also included are modifications of glycosylation, e.g. those made by modifying the glycosylation patterns of a polypeptide during its synthesis and processing or in further processing steps; e.g. by exposing the polypeptide to enzymes which affect glycosylation, such as mammalian glycosylating or deglycosylating enzymes. Also embraced are sequences that have phosphorylated amino acid residues, e.g. phosphotyrosine, phosphoserine, or phosphothreonine.

Also included in the subject invention are DNA-targeting RNAs and site-directed modifying polypeptides that have been modified using ordinary molecular biological techniques and synthetic chemistry so as to improve their resistance to proteolytic degradation, to change the target sequence specificity, to optimize solubility properties, to alter protein activity (e.g., transcription modulatory activity, enzymatic activity, etc) or to render them more suitable as a therapeutic agent. Analogs of such polypeptides include those containing residues other than naturally occurring L-amino acids, e.g. D-amino acids or non-naturally occurring synthetic amino acids. D-amino acids may be substituted for some or all of the amino acid residues.

The site-directed modifying polypeptides may be prepared by in vitro synthesis, using conventional methods as known in the art. Various commercial synthetic apparatuses are available, for example, automated synthesizers by Applied Biosystems, Inc., Beckman, etc. By using synthesizers, naturally occurring amino acids may be substituted with unnatural amino acids. The particular sequence and the manner of preparation will be determined by convenience, economics, purity required, and the like.

If desired, various groups may be introduced into the peptide during synthesis or during expression, which allow for linking to other molecules or to a surface. Thus cysteines can be used to make thioethers, histidines for linking to a metal ion complex, carboxyl groups for forming amides or esters, amino groups for forming amides, and the like.

The site-directed modifying polypeptides may also be isolated and purified in accordance with conventional methods of recombinant synthesis. A lysate may be prepared of the expression host and the lysate purified using HPLC, exclusion chromatography, gel electrophoresis, affinity chromatography, or other purification technique. For the most part, the compositions which are used will comprise at least 20% by weight of the desired product, more usually at least about 75% by weight, preferably at least about 95% by weight, and for therapeutic purposes, usually at least about 99.5% by weight, in relation to contaminants related to the method of preparation of the product and its purification. Usually, the percentages will be based upon total protein.

To induce DNA cleavage and recombination, or any desired modification to a target DNA, or any desired modification to a polypeptide associated with target DNA, the DNA-targeting RNA and/or the site-directed modifying polypeptide and/or the donor polynucleotide, whether they be introduced as nucleic acids or polypeptides, are provided to the cells for about 30 minutes to about 24 hours, e.g., 1 hour, 1.5 hours, 2 hours, 2.5 hours, 3 hours, 3.5 hours 4 hours, 5 hours, 6 hours, 7 hours, 8 hours, 12 hours, 16 hours, 18 hours, 20 hours, or any other period from about 30 minutes to about 24 hours, which may be repeated with a frequency of about every day to about every 4 days, e.g., every 1.5 days, every 2 days, every 3 days, or any other frequency from about every day to about every four days. The agent(s) may be provided to the subject cells one or more times, e.g. one time, twice, three times, or more than three times, and the cells allowed to incubate with the agent(s) for some amount of time following each contacting event e.g. 16-24 hours, after which time the media is replaced with fresh media and the cells are cultured further.

In cases in which two or more different targeting complexes are provided to the cell (e.g., two different DNA-targeting RNAs that are complementary to different sequences within the same or different target DNA), the complexes may be provided simultaneously (e.g. as two polypeptides and/or nucleic acids), or delivered simultaneously. Alternatively, they may be provided consecutively, e.g. the targeting complex being provided first, followed by the second targeting complex, etc. or vice versa.

Typically, an effective amount of the DNA-targeting RNA and/or site-directed modifying polypeptide and/or donor polynucleotide is provided to the target DNA or cells to induce cleavage. An effective amount of the DNA-targeting RNA and/or site-directed modifying polypeptide and/or donor polynucleotide is the amount to induce a 2-fold increase or more in the amount of target modification observed between two homologous sequences relative to a negative control, e.g. a cell contacted with an empty vector or irrelevant polypeptide. That is to say, an effective amount or dose of the DNA-targeting RNA and/or site-directed modifying polypeptide and/or donor polynucleotide will induce a 2-fold increase, a 3-fold increase, a 4-fold increase or more in the amount of target modification observed at a target DNA region, in some instances a 5-fold increase, a 6-fold increase or more, sometimes a 7-fold or 8-fold increase or more in the amount of recombination observed, e.g. an increase of 10-fold, 50-fold, or 100-fold or more, in some instances, an increase of 200-fold, 500-fold, 700-fold, or 1000-fold or more, e.g. a 5000-fold, or 10,000-fold increase in the amount of recombination observed. The amount of target modification may be measured by any convenient method. For example, a silent reporter construct comprising complementary sequence to the targeting segment (targeting sequence) of the DNA-targeting RNA flanked by repeat sequences that, when recombined, will reconstitute a nucleic acid encoding an active reporter may be cotransfected into the cells, and the amount of reporter protein assessed after contact with the DNA-targeting RNA and/or site-directed modifying polypeptide and/or donor polynucleotide, e.g. 2 hours, 4 hours, 8 hours, 12 hours, 24 hours, 36 hours, 48 hours, 72 hours or more after contact with the DNA-targeting RNA and/or site-directed modifying polypeptide and/or donor polynucleotide. As another, more sensitivity assay, for example, the extent of recombination at a genomic DNA region of interest comprising target DNA sequences may be assessed by PCR or Southern hybridization of the region after contact with a DNA-targeting RNA and/or site-directed modifying polypeptide and/or donor polynucleotide, e.g. 2 hours, 4 hours, 8 hours, 12 hours, 24 hours, 36 hours, 48 hours, 72 hours or more after contact with the DNA-targeting RNA and/or site-directed modifying polypeptide and/or donor polynucleotide.

Contacting the cells with a DNA-targeting RNA and/or site-directed modifying polypeptide and/or donor polynucleotide may occur in any culture media and under any culture conditions that promote the survival of the cells. For example, cells may be suspended in any appropriate nutrient medium that is convenient, such as Iscove's modified DMEM or RPMI 1640, supplemented with fetal calf serum or heat inactivated goat serum (about 5-10%), L-glutamine, a thiol, particularly 2-mercaptoethanol, and antibiotics, e.g. penicillin and streptomycin. The culture may contain growth factors to which the cells are responsive. Growth factors, as defined herein, are molecules capable of promoting survival, growth and/or differentiation of cells, either in culture or in the intact tissue, through specific effects on a transmembrane receptor. Growth factors include polypeptides and non-polypeptide factors. Conditions that promote the survival of cells are typically permissive of nonhomologous end joining and homology-directed repair.

In applications in which it is desirable to insert a polynucleotide sequence into a target DNA sequence, a polynucleotide comprising a donor sequence to be inserted is also provided to the cell. By a "donor sequence" or "donor polynucleotide" it is meant a nucleic acid sequence to be inserted at the cleavage site induced by a site-directed modifying polypeptide. The donor polynucleotide will contain sufficient homology to a genomic sequence at the cleavage site, e.g. 70%, 80%, 85%, 90%, 95%, or 100% homology with the nucleotide sequences flanking the cleavage site, e.g. within about 50 bases or less of the cleavage site, e.g. within about 30 bases, within about 15 bases, within about 10 bases, within about 5 bases, or immediately flanking the cleavage site, to support homology-directed repair between it and the genomic sequence to which it bears homology. Approximately 25, 50, 100, or 200 nucleotides, or more than 200 nucleotides, of sequence homology between a donor and a genomic sequence (or any integral value between 10 and 200 nucleotides, or more) will support homology-directed repair. Donor sequences can be of any length, e.g. 10 nucleotides or more, 50 nucleotides or more, 100 nucleotides or more, 250 nucleotides or more, 500 nucleotides or more, 1000 nucleotides or more, 5000 nucleotides or more, etc.

The donor sequence is typically not identical to the genomic sequence that it replaces. Rather, the donor sequence may contain at least one or more single base changes, insertions, deletions, inversions or rearrangements with respect to the genomic sequence, so long as sufficient homology is present to support homology-directed repair. In some embodiments, the donor sequence comprises a non-homologous sequence flanked by two regions of homology, such that homology-directed repair between the target DNA region and the two flanking sequences results in insertion of the non-homologous sequence at the target region. Donor sequences may also comprise a vector backbone containing sequences that are not homologous to the DNA region of interest and that are not intended for insertion into the DNA region of interest. Generally, the homologous region(s) of a donor sequence will have at least 50% sequence identity to a genomic sequence with which recombination is desired. In certain embodiments, 60%, 70%, 80%, 90%, 95%, 98%, 99%, or 99.9% sequence identity is present. Any value between 1% and 100% sequence identity can be present, depending upon the length of the donor polynucleotide.

The donor sequence may comprise certain sequence differences as compared to the genomic sequence, e.g. restriction sites, nucleotide polymorphisms, selectable markers (e.g., drug resistance genes, fluorescent proteins, enzymes etc.), etc., which may be used to assess for successful insertion of the donor sequence at the cleavage site or in some cases may be used for other purposes (e.g., to signify expression at the targeted genomic locus). In some cases, if located in a coding region, such nucleotide sequence differences will not change the amino acid sequence, or will make silent amino acid changes (i.e., changes which do not affect the structure or function of the protein). Alternatively, these sequences differences may include flanking recombination sequences such as FLPs, loxP sequences, or the like, that can be activated at a later time for removal of the marker sequence.

The donor sequence may be provided to the cell as single-stranded DNA, single-stranded RNA, double-stranded DNA, or double-stranded RNA. It may be introduced into a cell in linear or circular form. If introduced in linear form, the ends of the donor sequence may be protected (e.g., from exonucleolytic degradation) by methods known to those of skill in the art. For example, one or more dideoxynucleotide residues are added to the 3' terminus of a linear molecule and/or self-complementary oligonucleotides are ligated to one or both ends. See, for example, Chang et al. (1987) Proc. Natl. Acad Sci USA 84:4959-4963; Nehls et al. (1996) Science 272:886-889. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues. As an alternative to protecting the termini of a linear donor sequence, additional lengths of sequence may be included outside of the regions of homology that can be degraded without impacting recombination. A donor sequence can be introduced into a cell as part of a vector molecule having additional sequences such as, for example, replication origins, promoters and genes encoding antibiotic resistance. Moreover, donor sequences can be introduced as naked nucleic acid, as nucleic acid complexed with an agent such as a liposome or poloxamer, or can be delivered by viruses (e.g., adenovirus, AAV), as described above for nucleic acids encoding a DNA-targeting RNA and/or site-directed modifying polypeptide and/or donor polynucleotide.

Following the methods described above, a DNA region of interest may be cleaved and modified, i.e. "genetically modified", ex vivo. In some embodiments, as when a selectable marker has been inserted into the DNA region of interest, the population of cells may be enriched for those comprising the genetic modification by separating the genetically modified cells from the remaining population. Prior to enriching, the "genetically modified" cells may make up only about 1% or more (e.g., 2% or more, 3% or more, 4% or more, 5% or more, 6% or more, 7% or more, 8% or more, 9% or more, 10% or more, 15% or more, or 20% or more) of the cellular population. Separation of "genetically modified" cells may be achieved by any convenient separation technique appropriate for the selectable marker used. For example, if a fluorescent marker has been inserted, cells may be separated by fluorescence activated cell sorting, whereas if a cell surface marker has been inserted, cells may be separated from the heterogeneous population by affinity separation techniques, e.g. magnetic separation, affinity chromatography, "panning" with an affinity reagent attached to a solid matrix, or other convenient technique. Techniques providing accurate separation include fluorescence activated cell sorters, which can have varying degrees of sophistication, such as multiple color channels, low angle and obtuse light scattering detecting channels, impedance channels, etc. The cells may be selected against dead cells by employing dyes associated with dead cells (e.g. propidium iodide). Any technique may be employed which is not unduly detrimental to the viability of the genetically modified cells. Cell compositions that are highly enriched for cells comprising modified DNA are achieved in this manner. By "highly enriched", it is meant that the genetically modified cells will be 70% or more, 75% or more, 80% or more, 85% or more, 90% or more of the cell composition, for example, about 95% or more, or 98% or more of the cell composition. In other words, the composition may be a substantially pure composition of genetically modified cells.

Genetically modified cells produced by the methods described herein may be used immediately. Alternatively, the cells may be frozen at liquid nitrogen temperatures and stored for long periods of time, being thawed and capable of being reused. In such cases, the cells will usually be frozen in 10% dimethylsulfoxide (DMSO), 50% serum, 40% buffered medium, or some other such solution as is commonly used in the art to preserve cells at such freezing temperatures, and thawed in a manner as commonly known in the art for thawing frozen cultured cells.

The genetically modified cells may be cultured in vitro under various culture conditions. The cells may be expanded in culture, i.e. grown under conditions that promote their proliferation. Culture medium may be liquid or semi-solid, e.g. containing agar, methylcellulose, etc. The cell population may be suspended in an appropriate nutrient medium, such as Iscove's modified DMEM or RPMI 1640, normally supplemented with fetal calf serum (about 5-10%), L-glutamine, a thiol, particularly 2-mercaptoethanol, and antibiotics, e.g. penicillin and streptomycin. The culture may contain growth factors to which the regulatory T cells are responsive. Growth factors, as defined herein, are molecules capable of promoting survival, growth and/or differentiation of cells, either in culture or in the intact tissue, through specific effects on a transmembrane receptor. Growth factors include polypeptides and non-polypeptide factors.

Cells that have been genetically modified in this way may be transplanted to a subject for purposes such as gene therapy, e.g. to treat a disease or as an antiviral, antipathogenic, or anticancer therapeutic, for the production of genetically modified organisms in agriculture, or for biological research. The subject may be a neonate, a juvenile, or an adult. Of particular interest are mammalian subjects. Mammalian species that may be treated with the present methods include canines and felines; equines; bovines; ovines; etc. and primates, particularly humans. Animal models, particularly small mammals (e.g. mouse, rat, guinea pig, hamster, lagomorpha (e.g., rabbit), etc.) may be used for experimental investigations.

Cells may be provided to the subject alone or with a suitable substrate or matrix, e.g. to support their growth and/or organization in the tissue to which they are being transplanted. Usually, at least $1\times10^3$ cells will be administered, for example $5\times10^3$ cells, $1\times10^4$ cells, $5\times10^4$ cells, $1\times10^5$ cells, $1\times10^6$ cells or more. The cells may be introduced to the subject via any of the following routes: parenteral, subcutaneous, intravenous, intracranial, intraspinal, intraocular, or into spinal fluid. The cells may be introduced by injection, catheter, or the like. Examples of methods for local delivery, that is, delivery to the site of injury, include, e.g. through an Ommaya reservoir, e.g. for intrathecal delivery (see e.g. U.S. Pat. Nos. 5,222,982 and 5,385,582, incorporated herein by reference); by bolus injection, e.g. by a syringe, e.g. into a joint; by continuous infusion, e.g. by cannulation, e.g. with convection (see e.g. US Application No. 20070254842, incorporated here by reference); or by implanting a device upon which the cells have been reversably affixed (see e.g. US Application Nos. 20080081064 and 20090196903, incorporated herein by reference). Cells may also be introduced into an embryo (e.g., a blastocyst) for the purpose of generating a transgenic animal (e.g., a transgenic mouse).

The number of administrations of treatment to a subject may vary. Introducing the genetically modified cells into the subject may be a one-time event; but in certain situations, such treatment may elicit improvement for a limited period of time and require an on-going series of repeated treatments. In other situations, multiple administrations of the genetically modified cells may be required before an effect is observed. The exact protocols depend upon the disease or condition, the stage of the disease and parameters of the individual subject being treated.

In other aspects of the invention, the DNA-targeting RNA and/or site-directed modifying polypeptide and/or donor polynucleotide are employed to modify cellular DNA in vivo, again for purposes such as gene therapy, e.g. to treat a disease or as an antiviral, antipathogenic, or anticancer therapeutic, for the production of genetically modified organisms in agriculture, or for biological research. In these in vivo embodiments, a DNA-targeting RNA and/or site-directed modifying polypeptide and/or donor polynucleotide are administered directly to the individual. A DNA-targeting RNA and/or site-directed modifying polypeptide and/or donor polynucleotide may be administered by any of a number of well-known methods in the art for the administration of peptides, small molecules and nucleic acids to a subject. A DNA-targeting RNA and/or site-directed modifying polypeptide and/or donor polynucleotide can be incorporated into a variety of formulations. More particularly, a DNA-targeting RNA and/or site-directed modifying polypeptide and/or donor polynucleotide of the present invention can be formulated into pharmaceutical compositions by combination with appropriate pharmaceutically acceptable carriers or diluents.

Pharmaceutical preparations are compositions that include one or more a DNA-targeting RNA and/or site-directed modifying polypeptide and/or donor polynucleotide present in a pharmaceutically acceptable vehicle. "Pharmaceutically acceptable vehicles" may be vehicles approved by a regulatory agency of the Federal or a state government or listed in the U.S. Pharmacopeia or other generally recognized pharmacopeia for use in mammals, such as humans. The term "vehicle" refers to a diluent, adjuvant, excipient, or carrier with which a compound of the invention is formulated for administration to a mammal Such pharmaceutical vehicles can be lipids, e.g. liposomes, e.g. liposome dendrimers; liquids, such as water and oils, including those of petroleum, animal, vegetable or synthetic origin, such as peanut oil, soybean oil, mineral oil, sesame oil and the like, saline; gum acacia, gelatin, starch paste, talc, keratin, colloidal silica, urea, and the like. In addition, auxiliary, stabilizing, thickening, lubricating and coloring agents may be used. Pharmaceutical compositions may be formulated into preparations in solid, semi-solid, liquid or gaseous forms, such as tablets, capsules, powders, granules, ointments, solutions, suppositories, injections, inhalants, gels, microspheres, and aerosols. As such, administration of the a DNA-targeting RNA and/or site-directed modifying polypeptide and/or donor polynucleotide can be achieved in various ways, including oral, buccal, rectal, parenteral, intraperitoneal, intradermal, transdermal, intratracheal, intraocular, etc., administration. The active agent may be systemic after administration or may be localized by the use of regional administration, intramural administration, or use of an implant that acts to retain the active dose at the site of implantation. The active agent may be formulated for immediate activity or it may be formulated for sustained release.

For some conditions, particularly central nervous system conditions, it may be necessary to formulate agents to cross the blood-brain barrier (BBB). One strategy for drug delivery through the blood-brain barrier (BBB) entails disruption of the BBB, either by osmotic means such as mannitol or leukotrienes, or biochemically by the use of vasoactive substances such as bradykinin. The potential for using BBB opening to target specific agents to brain tumors is also an option. A BBB disrupting agent can be co-administered with the therapeutic compositions of the invention when the compositions are administered by intravascular injection. Other strategies to go through the BBB may entail the use of endogenous transport systems, including Caveolin-1 mediated transcytosis, carrier-mediated transporters such as glucose and amino acid carriers, receptor-mediated transcytosis for insulin or transferrin, and active efflux transporters such as p-glycoprotein. Active transport moieties may also be conjugated to the therapeutic compounds for use in the invention to facilitate transport across the endothelial wall of the blood vessel. Alternatively, drug delivery of therapeutics agents behind the BBB may be by local delivery, for example by intrathecal delivery, e.g. through an Ommaya reservoir (see e.g. U.S. Pat. Nos. 5,222,982 and 5,385,582, incorporated herein by reference); by bolus injection, e.g. by a syringe, e.g. intravitreally or intracranially; by continuous infusion, e.g. by cannulation, e.g. with convection (see e.g. US Application No. 20070254842, incorporated here by reference); or by implanting a device upon which the agent has been reversably affixed (see e.g. US Application Nos. 20080081064 and 20090196903, incorporated herein by reference).

Typically, an effective amount of a DNA-targeting RNA and/or site-directed modifying polypeptide and/or donor polynucleotide are provided. As discussed above with regard to ex vivo methods, an effective amount or effective dose of a DNA-targeting RNA and/or site-directed modifying polypeptide and/or donor polynucleotide in vivo is the amount to induce a 2 fold increase or more in the amount of recombination observed between two homologous sequences relative to a negative control, e.g. a cell contacted with an empty vector or irrelevant polypeptide. The amount of recombination may be measured by any convenient method, e.g. as described above and known in the art. The calculation of the effective amount or effective dose of a DNA-targeting RNA and/or site-directed modifying polypeptide and/or donor polynucleotide to be administered is within the skill of one of ordinary skill in the art, and will be routine to those persons skilled in the art. The final amount to be administered will be dependent upon the route of administration and upon the nature of the disorder or condition that is to be treated.

The effective amount given to a particular patient will depend on a variety of factors, several of which will differ from patient to patient. A competent clinician will be able to determine an effective amount of a therapeutic agent to administer to a patient to halt or reverse the progression of the disease condition as required. Utilizing LD50 animal data, and other information available for the agent, a clinician can determine the maximum safe dose for an individual, depending on the route of administration. For instance, an intravenously administered dose may be more than an intrathecally administered dose, given the greater body of fluid into which the therapeutic composition is being administered. Similarly, compositions which are rapidly cleared from the body may be administered at higher doses, or in repeated doses, in order to maintain a therapeutic concentration. Utilizing ordinary skill, the competent clinician will be able to optimize the dosage of a particular therapeutic in the course of routine clinical trials.

For inclusion in a medicament, a DNA-targeting RNA and/or site-directed modifying polypeptide and/or donor polynucleotide may be obtained from a suitable commercial source. As a general proposition, the total pharmaceutically effective amount of the a DNA-targeting RNA and/or site-directed modifying polypeptide and/or donor polynucleotide administered parenterally per dose will be in a range that can be measured by a dose response curve.

Therapies based on a DNA-targeting RNA and/or site-directed modifying polypeptide and/or donor polynucleotides, i.e. preparations of a DNA-targeting RNA and/or site-directed modifying polypeptide and/or donor polynucleotide to be used for therapeutic administration, must be sterile. Sterility is readily accomplished by filtration through sterile filtration membranes (e.g., 0.2 µm membranes). Therapeutic compositions generally are placed into a container having a sterile access port, for example, an intravenous solution bag or vial having a stopper pierceable by a hypodermic injection needle. The therapies based on a DNA-targeting RNA and/or site-directed modifying polypeptide and/or donor polynucleotide may be stored in unit or multi-dose containers, for example, sealed ampules or vials, as an aqueous solution or as a lyophilized formulation for reconstitution. As an example of a lyophilized formulation, 10-mL vials are filled with 5 ml of sterile-filtered 1% (w/v) aqueous solution of compound, and the resulting mixture is lyophilized. The infusion solution is prepared by reconstituting the lyophilized compound using bacteriostatic Water-for-Injection.

Pharmaceutical compositions can include, depending on the formulation desired, pharmaceutically-acceptable, non-toxic carriers of diluents, which are defined as vehicles commonly used to formulate pharmaceutical compositions for animal or human administration. The diluent is selected so as not to affect the biological activity of the combination. Examples of such diluents are distilled water, buffered water, physiological saline, PBS, Ringer's solution, dextrose solution, and Hank's solution. In addition, the pharmaceutical composition or formulation can include other carriers, adjuvants, or non-toxic, nontherapeutic, nonimmunogenic stabilizers, excipients and the like. The compositions can also include additional substances to approximate physiological conditions, such as pH adjusting and buffering agents, toxicity adjusting agents, wetting agents and detergents.

The composition can also include any of a variety of stabilizing agents, such as an antioxidant for example. When the pharmaceutical composition includes a polypeptide, the polypeptide can be complexed with various well-known compounds that enhance the in vivo stability of the polypeptide, or otherwise enhance its pharmacological properties (e.g., increase the half-life of the polypeptide, reduce its toxicity, enhance solubility or uptake). Examples of such modifications or complexing agents include sulfate, gluconate, citrate and phosphate. The nucleic acids or polypeptides of a composition can also be complexed with molecules that enhance their in vivo attributes. Such molecules include, for example, carbohydrates, polyamines, amino acids, other peptides, ions (e.g., sodium, potassium, calcium, magnesium, manganese), and lipids.

Further guidance regarding formulations that are suitable for various types of administration can be found in Remington's Pharmaceutical Sciences, Mace Publishing Company, Philadelphia, Pa., 17th ed. (1985). For a brief review of methods for drug delivery, see, Langer, Science 249: 1527-1533 (1990).

The pharmaceutical compositions can be administered for prophylactic and/or therapeutic treatments. Toxicity and therapeutic efficacy of the active ingredient can be determined according to standard pharmaceutical procedures in cell cultures and/or experimental animals, including, for example, determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Therapies that exhibit large therapeutic indices are preferred.

The data obtained from cell culture and/or animal studies can be used in formulating a range of dosages for humans. The dosage of the active ingredient typically lines within a range of circulating concentrations that include the ED50 with low toxicity. The dosage can vary within this range depending upon the dosage form employed and the route of administration utilized.

The components used to formulate the pharmaceutical compositions are preferably of high purity and are substantially free of potentially harmful contaminants (e.g., at least National Food (NF) grade, generally at least analytical grade, and more typically at least pharmaceutical grade). Moreover, compositions intended for in vivo use are usually sterile. To the extent that a given compound must be synthesized prior to use, the resulting product is typically substantially free of any potentially toxic agents, particularly any endotoxins, which may be present during the synthesis or purification process. Compositions for parental administration are also sterile, substantially isotonic and made under GMP conditions.

The effective amount of a therapeutic composition to be given to a particular patient will depend on a variety of factors, several of which will differ from patient to patient. A competent clinician will be able to determine an effective amount of a therapeutic agent to administer to a patient to halt or reverse the progression the disease condition as required. Utilizing LD50 animal data, and other information available for the agent, a clinician can determine the maximum safe dose for an individual, depending on the route of administration. For instance, an intravenously administered dose may be more than an intrathecally administered dose, given the greater body of fluid into which the therapeutic composition is being administered. Similarly, compositions which are rapidly cleared from the body may be administered at higher doses, or in repeated doses, in order to maintain a therapeutic concentration. Utilizing ordinary skill, the competent clinician will be able to optimize the dosage of a particular therapeutic in the course of routine clinical trials.

Genetically Modified Host Cells

The present disclosure provides genetically modified host cells, including isolated genetically modified host cells, where a subject genetically modified host cell comprises (has been genetically modified with: 1) an exogenous DNA-targeting RNA; 2) an exogenous nucleic acid comprising a nucleotide sequence encoding a DNA-targeting RNA; 3) an exogenous site-directed modifying polypeptide (e.g., a naturally occurring Cas9; a modified, i.e., mutated or variant, Cas9; a chimeric Cas9; etc.); 4) an exogenous nucleic acid comprising a nucleotide sequence encoding a site-directed modifying polypeptide; or 5) any combination of the above. A subject genetically modified cell is generated by genetically modifying a host cell with, for example: 1) an exogenous DNA-targeting RNA; 2) an exogenous nucleic acid comprising a nucleotide sequence encoding a DNA-targeting RNA; 3) an exogenous site-directed modifying polypeptide; 4) an exogenous nucleic acid comprising a nucleotide sequence encoding a site-directed modifying polypeptide; or 5) any combination of the above.).

All cells suitable to be a target cell are also suitable to be a genetically modified host cell. For example, a genetically modified host cells of interest can be a cell from any organism (e.g. a bacterial cell, an archaeal cell, a cell of a single-cell eukaryotic organism, a plant cell, an algal cell, e.g., *Botryococcus braunii, Chlamydomonas reinhardtii, Nannochloropsis gaditana, Chlorella pyrenoidosa, Sargassum patens C. Agardh*, and the like, a fungal cell (e.g., a yeast cell), an animal cell, a cell from an invertebrate animal (e.g. fruit fly, cnidarian, echinoderm, nematode, etc.), a cell from a vertebrate animal (e.g., fish, amphibian, reptile, bird, mammal), a cell from a mammal (e.g., a pig, a cow, a goat, a sheep, a rodent, a rat, a mouse, a non-human primate, a human, etc.), etc.

In some embodiments, a genetically modified host cell has been genetically modified with an exogenous nucleic acid comprising a nucleotide sequence encoding a site-directed modifying polypeptide (e.g., a naturally occurring Cas9; a modified, i.e., mutated or variant, Cas9; a chimeric Cas9; etc.). The DNA of a genetically modified host cell can be targeted for modification by introducing into the cell a DNA-targeting RNA (or a DNA encoding a DNA-targeting RNA, which determines the genomic location/sequence to be modified) and optionally a donor nucleic acid. In some embodiments, the nucleotide sequence encoding a site-directed modifying polypeptide is operably linked to an inducible promoter (e.g., heat shock promoter, Tetracycline-regulated promoter, Steroid-regulated promoter, Metal-regulated promoter, estrogen receptor-regulated promoter, etc.). In some embodiments, the nucleotide sequence encoding a site-directed modifying polypeptide is operably linked to a spatially restricted and/or temporally restricted promoter (e.g., a tissue specific promoter, a cell type specific promoter, etc.). In some embodiments, the nucleotide sequence encoding a site-directed modifying polypeptide is operably linked to a constitutive promoter.

In some embodiments, a subject genetically modified host cell is in vitro. In some embodiments, a subject genetically modified host cell is in vivo. In some embodiments, a subject genetically modified host cell is a prokaryotic cell or is derived from a prokaryotic cell. In some embodiments, a subject genetically modified host cell is a bacterial cell or is derived from a bacterial cell. In some embodiments, a subject genetically modified host cell is an archaeal cell or is derived from an archaeal cell. In some embodiments, a subject genetically modified host cell is a eukaryotic cell or is derived from a eukaryotic cell. In some embodiments, a subject genetically modified host cell is a plant cell or is derived from a plant cell. In some embodiments, a subject genetically modified host cell is an animal cell or is derived from an animal cell. In some embodiments, a subject genetically modified host cell is an invertebrate cell or is derived from an invertebrate cell. In some embodiments, a subject genetically modified host cell is a vertebrate cell or is derived from a vertebrate cell. In some embodiments, a subject genetically modified host cell is a mammalian cell or is derived from a mammalian cell. In some embodiments, a subject genetically modified host cell is a rodent cell or is derived from a rodent cell. In some embodiments, a subject genetically modified host cell is a human cell or is derived from a human cell.

The present disclosure further provides progeny of a subject genetically modified cell, where the progeny can comprise the same exogenous nucleic acid or polypeptide as the subject genetically modified cell from which it was derived. The present disclosure further provides a composition comprising a subject genetically modified host cell.

Genetically Modified Stem Cells and Genetically Modified Progenitor Cells

In some embodiments, a subject genetically modified host cell is a genetically modified stem cell or progenitor cell. Suitable host cells include, e.g., stem cells (adult stem cells, embryonic stem cells, iPS cells, etc.) and progenitor cells (e.g., cardiac progenitor cells, neural progenitor cells, etc.). Suitable host cells include mammalian stem cells and progenitor cells, including, e.g., rodent stem cells, rodent progenitor cells, human stem cells, human progenitor cells, etc. Suitable host cells include in vitro host cells, e.g., isolated host cells.

In some embodiments, a subject genetically modified host cell comprises an exogenous DNA-targeting RNA nucleic acid. In some embodiments, a subject genetically modified host cell comprises an exogenous nucleic acid comprising a nucleotide sequence encoding a DNA-targeting RNA. In some embodiments, a subject genetically modified host cell comprises an exogenous site-directed modifying polypeptide (e.g., a naturally occurring Cas9; a modified, i.e., mutated or variant, Cas9; a chimeric Cas9; etc.). In some embodiments, a subject genetically modified host cell comprises an exogenous nucleic acid comprising a nucleotide sequence encoding a site-directed modifying polypeptide. In some embodiments, a subject genetically modified host cell comprises exogenous nucleic acid comprising a nucleotide sequence encoding 1) a DNA-targeting RNA and 2) a site-directed modifying polypeptide.

In some cases, the site-directed modifying polypeptide comprises an amino acid sequence having at least about 75%, at least about 80%, at least about 85%, at least about 90%, at least about 95%, or at least about 99%, or 100%, amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346.

Compositions

The present invention provides a composition comprising a subject DNA-targeting RNA and/or a site-directed modifying polypeptide. In some cases, the site-directed modifying polypeptide is a subject chimeric polypeptide. A subject composition is useful for carrying out a method of the present disclosure, e.g., a method for site-specific modification of a target DNA; a method for site-specific modification of a polypeptide associated with a target DNA; etc.

Compositions Comprising a DNA-Targeting RNA

The present invention provides a composition comprising a subject DNA-targeting RNA. The composition can comprise, in addition to the DNA-targeting RNA, one or more of: a salt, e.g., NaCl, $MgCl_2$, KCl, $MgSO_4$, etc.; a buffering agent, e.g., a Tris buffer, N-(2-Hydroxyethyl)piperazine-N'-(2-ethanesulfonic acid) (HEPES), 2-(N-Morpholino)ethanesulfonic acid (MES), MES sodium salt, 3-(N-Morpholino)propanesulfonic acid (MOPS), N-tris[Hydroxymethyl]methyl-3-aminopropanesulfonic acid (TAPS), etc.; a solubilizing agent; a detergent, e.g., a non-ionic detergent such as Tween-20, etc.; a nuclease inhibitor; and the like. For example, in some cases, a subject composition comprises a subject DNA-targeting RNA and a buffer for stabilizing nucleic acids.

In some embodiments, a DNA-targeting RNA present in a subject composition is pure, e.g., at least about 75%, at least about 80%, at least about 85%, at least about 90%, at least about 95%, at least about 98%, at least about 99%, or more than 99% pure, where "% purity" means that DNA-targeting RNA is the recited percent free from other macromolecules, or contaminants that may be present during the production of the DNA-targeting RNA.

Compositions Comprising a Subject Chimeric Polypeptide

The present invention provides a composition a subject chimeric polypeptide. The composition can comprise, in addition to the DNA-targeting RNA, one or more of: a salt, e.g., NaCl, $MgCl_2$, KCl, $MgSO_4$, etc.; a buffering agent, e.g., a Tris buffer, HEPES, MES, MES sodium salt, MOPS, TAPS, etc.; a solubilizing agent; a detergent, e.g., a non-ionic detergent such as Tween-20, etc.; a protease inhibitor; a reducing agent (e.g., dithiothreitol); and the like.

In some embodiments, a subject chimeric polypeptide present in a subject composition is pure, e.g., at least about 75%, at least about 80%, at least about 85%, at least about 90%, at least about 95%, at least about 98%, at least about 99%, or more than 99% pure, where "% purity" means that the site-directed modifying polypeptide is the recited percent free from other proteins, other macromolecules, or contaminants that may be present during the production of the chimeric polypeptide.

Compositions Comprising a DNA-Targeting RNA and a Site-Directed Modifying Polypeptide The present invention provides a composition comprising: (i) a DNA-targeting RNA or a DNA polynucleotide encoding the same; and ii) a site-directed modifying polypeptide, or a polynucleotide encoding the same. In some cases, the site-directed modifying polypeptide is a subject chimeric site-directed modifying polypeptide. In other cases, the site-directed modifying polypeptide is a naturally-occurring site-directed modifying polypeptide. In some instances, the site-directed modifying polypeptide exhibits enzymatic activity that modifies a target DNA. In other cases, the site-directed modifying polypeptide exhibits enzymatic activity that modifies a polypeptide that is associated with a target DNA. In still other cases, the site-directed modifying polypeptide modulates transcription of the target DNA.

The present invention provides a composition comprising: (i) a DNA-targeting RNA, as described above, or a DNA polynucleotide encoding the same, the DNA-targeting RNA comprising: (a) a first segment comprising a nucleotide sequence that is complementary to a sequence in a target DNA; and (b) a second segment that interacts with a site-directed modifying polypeptide; and (ii) the site-directed modifying polypeptide, or a polynucleotide encoding the same, the site-directed modifying polypeptide comprising: (a) an RNA-binding portion that interacts with the DNA-targeting RNA; and (b) an activity portion that exhibits site-directed enzymatic activity, wherein the site of enzymatic activity is determined by the DNA-targeting RNA.

In some instances, a subject composition comprises: a composition comprising: (i) a subject DNA-targeting RNA, the DNA-targeting RNA comprising: (a) a first segment comprising a nucleotide sequence that is complementary to a sequence in a target DNA; and (b) a second segment that interacts with a site-directed modifying polypeptide; and (ii) the site-directed modifying polypeptide, the site-directed modifying polypeptide comprising: (a) an RNA-binding portion that interacts with the DNA-targeting RNA; and (b) an activity portion that exhibits site-directed enzymatic activity, wherein the site of enzymatic activity is determined by the DNA-targeting RNA.

In other embodiments, a subject composition comprises: (i) a polynucleotide encoding a subject DNA-targeting RNA, the DNA-targeting RNA comprising: (a) a first segment comprising a nucleotide sequence that is complementary to a sequence in a target DNA; and (b) a second segment that interacts with a site-directed modifying polypeptide; and (ii) a polynucleotide encoding the site-directed modifying polypeptide, the site-directed modifying polypeptide comprising: (a) an RNA-binding portion that interacts with the DNA-targeting RNA; and (b) an activity portion that exhibits site-directed enzymatic activity, wherein the site of enzymatic activity is determined by the DNA-targeting RNA.

In some embodiments, a subject composition includes both RNA molecules of a double-molecule DNA-targeting RNA. As such, in some embodiments, a subject composition includes an activator-RNA that comprises a duplex-forming segment that is complementary to the duplex-forming segment of a targeter-RNA (see FIG. 1A). The duplex-forming segments of the activator-RNA and the targeter-RNA hybridize to form the dsRNA duplex of the protein-binding segment of the DNA-targeting RNA. The targeter-RNA further provides the DNA-targeting segment (single stranded) of the DNA-targeting RNA and therefore targets the DNA-targeting RNA to a specific sequence within the target DNA. As one non-limiting example, the duplex-forming segment of the activator-RNA comprises a nucleotide sequence that has at least about 70%, at least about 80%, at least about 90%, at least about 95%, at least about 98%, or 100% identity with the sequence 5'-UAGCAAGUUAAAAU-3' (SEQ ID NO:562). As another non-limiting example, the duplex-forming segment of the targeter-RNA comprises a nucleotide sequence that has at least about 70%, at least about 80%, at least about 90%, at least about 95%, at least about 98%, or 100% identity with the sequence 5'-GUUUUA-GAGCUA-3' (SEQ ID NO:679).

The present disclosure provides a composition comprising: (i) a DNA-targeting RNA, or a DNA polynucleotide encoding the same, the DNA-targeting RNA comprising: (a) a first segment comprising a nucleotide sequence that is complementary to a sequence in a target DNA; and (b) a second segment that interacts with a site-directed modifying polypeptide; and (ii) the site-directed modifying polypeptide, or a polynucleotide encoding the same, the site-directed modifying polypeptide comprising: (a) an RNA-binding portion that interacts with the DNA-targeting RNA; and (b) an activity portion that modulates transcription within the target DNA, wherein the site of modulated transcription within the target DNA is determined by the DNA-targeting RNA.

For example, in some cases, a subject composition comprises: (i) a DNA-targeting RNA, the DNA-targeting RNA comprising: (a) a first segment comprising a nucleotide sequence that is complementary to a sequence in a target DNA; and (b) a second segment that interacts with a site-directed modifying polypeptide; and (ii) the site-directed modifying polypeptide, the site-directed modifying polypeptide comprising: (a) an RNA-binding portion that interacts with the DNA-targeting RNA; and (b) an activity portion that modulates transcription within the target DNA, wherein the site of modulated transcription within the target DNA is determined by the DNA-targeting RNA.

As another example, in some cases, a subject composition comprises: (i) a DNA polynucleotide encoding a DNA-targeting RNA, the DNA-targeting RNA comprising: (a) a first segment comprising a nucleotide sequence that is complementary to a sequence in a target DNA; and (b) a second segment that interacts with a site-directed modifying polypeptide; and (ii) a polynucleotide encoding the site-directed modifying polypeptide, the site-directed modifying polypeptide comprising: (a) an RNA-binding portion that interacts with the DNA-targeting RNA; and (b) an activity portion that modulates transcription within the target DNA, wherein the site of modulated transcription within the target DNA is determined by the DNA-targeting RNA.

A subject composition can comprise, in addition to i) a subject DNA-targeting RNA, or a DNA polynucleotide encoding the same; and ii) a site-directed modifying polypeptide, or a polynucleotide encoding the same, one or more of: a salt, e.g., NaCl, MgCl$_2$, KCl, MgSO$_4$, etc.; a buffering agent, e.g., a Tris buffer, HEPES, MES, MES sodium salt, MOPS, TAPS, etc.; a solubilizing agent; a detergent, e.g., a non-ionic detergent such as Tween-20, etc.; a protease inhibitor; a reducing agent (e.g., dithiothreitol); and the like.

In some cases, the components of the composition are individually pure, e.g., each of the components is at least about 75%, at least about 80%, at least about 90%, at least about 95%, at least about 98%, at least about 99%, or at least 99%, pure. In some cases, the individual components of a subject composition are pure before being added to the composition.

For example, in some embodiments, a site-directed modifying polypeptide present in a subject composition is pure, e.g., at least about 75%, at least about 80%, at least about 85%, at least about 90%, at least about 95%, at least about 98%, at least about 99%, or more than 99% pure, where "% purity" means that the site-directed modifying polypeptide is the recited percent free from other proteins (e.g., proteins other than the site-directed modifying polypeptide), other macromolecules, or contaminants that may be present during the production of the site-directed modifying polypeptide.

Kits

The present disclosure provides kits for carrying out a subject method. A subject kit can include one or more of: a site-directed modifying polypeptide; a nucleic acid comprising a nucleotide encoding a site-directed modifying polypeptide; a DNA-targeting RNA; a nucleic acid comprising a nucleotide sequence encoding a DNA-targeting RNA; an activator-RNA; a nucleic acid comprising a nucleotide sequence encoding an activator-RNA; a targeter-RNA; and a nucleic acid comprising a nucleotide sequence encoding a targeter-RNA. A site-directed modifying polypeptide; a nucleic acid comprising a nucleotide encoding a site-directed modifying polypeptide; a DNA-targeting RNA; a nucleic acid comprising a nucleotide sequence encoding a DNA-targeting RNA; an activator-RNA; a nucleic acid comprising a nucleotide sequence encoding an activator-RNA; a targeter-RNA; and a nucleic acid comprising a nucleotide sequence encoding a targeter-RNA, are described in detail above. A kit may comprise a complex that comprises two or more of: a site-directed modifying polypeptide; a nucleic acid comprising a nucleotide encoding a site-directed modifying polypeptide; a DNA-targeting RNA; a nucleic acid comprising a nucleotide sequence encoding a DNA-targeting RNA; an activator-RNA; a nucleic acid comprising a nucleotide sequence encoding an activator-RNA; a targeter-RNA; and a nucleic acid comprising a nucleotide sequence encoding a targeter-RNA.

In some embodiments, a subject kit comprises a site-directed modifying polypeptide, or a polynucleotide encoding the same. In some embodiments, the site-directed modifying polypeptide comprises: (a) an RNA-binding portion that interacts with the DNA-targeting RNA; and (b) an activity portion that modulates transcription within the target DNA, wherein the site of modulated transcription within the target DNA is determined by the DNA-targeting RNA. In some cases, the activity portion of the site-directed modifying polypeptide exhibits reduced or inactivated nuclease activity. In some cases, the site-directed modifying polypeptide is a chimeric site-directed modifying polypeptide.

In some embodiments, a subject kit comprises: a site-directed modifying polypeptide, or a polynucleotide encoding the same, and a reagent for reconstituting and/or diluting the site-directed modifying polypeptide. In other embodiments, a subject kit comprises a nucleic acid (e.g., DNA, RNA) comprising a nucleotide encoding a site-directed modifying polypeptide. In some embodiments, a subject kit comprises: a nucleic acid (e.g., DNA, RNA) comprising a nucleotide encoding a site-directed modifying polypeptide; and a reagent for reconstituting and/or diluting the site-directed modifying polypeptide.

A subject kit comprising a site-directed modifying polypeptide, or a polynucleotide encoding the same, can further include one or more additional reagents, where such additional reagents can be selected from: a buffer for introducing the site-directed modifying polypeptide into a cell; a wash buffer; a control reagent; a control expression vector or RNA polynucleotide; a reagent for in vitro production of the site-directed modifying polypeptide from DNA, and the like. In some cases, the site-directed modifying polypeptide included in a subject kit is a chimeric site-directed modifying polypeptide, as described above.

In some embodiments, a subject kit comprises a DNA-targeting RNA, or a DNA polynucleotide encoding the same, the DNA-targeting RNA comprising: (a) a first segment comprising a nucleotide sequence that is complementary to a sequence in a target DNA; and (b) a second segment that interacts with a site-directed modifying polypeptide. In some embodiments, the DNA-targeting RNA further comprises a third segment (as described above). In some embodiments, a subject kit comprises: (i) a DNA-targeting RNA, or a DNA polynucleotide encoding the same, the DNA-targeting RNA comprising: (a) a first segment comprising a nucleotide sequence that is complementary to a sequence in a target DNA; and (b) a second segment that interacts with a site-directed modifying polypeptide; and (ii) a site-directed modifying polypeptide, or a polynucleotide encoding the same, the site-directed modifying polypeptide comprising: (a) an RNA-binding portion that interacts with the DNA-targeting RNA; and (b) an activity portion that exhibits site-directed enzymatic activity, wherein the site of enzymatic activity is determined by the DNA-targeting RNA. In some embodiments, the activity portion of the site-directed modifying polypeptide does not exhibit enzymatic activity (comprises an inactivated nuclease, e.g., via mutation). In some cases, the kit comprises a DNA-targeting RNA and a site-directed modifying polypeptide. In other cases, the kit comprises: (i) a nucleic acid comprising a nucleotide sequence encoding a DNA-targeting RNA; and (ii) a nucleic acid comprising a nucleotide sequence encoding site-directed modifying polypeptide.

As another example, a subject kit can include: (i) a DNA-targeting RNA, or a DNA polynucleotide encoding the same, comprising: (a) a first segment comprising a nucleotide sequence that is complementary to a sequence in a target DNA; and (b) a second segment that interacts with a site-directed modifying polypeptide; and (ii) the site-directed modifying polypeptide, or a polynucleotide encoding the same, comprising: (a) an RNA-binding portion that interacts with the DNA-targeting RNA; and (b) an activity portion that that modulates transcription within the target DNA, wherein the site of modulated transcription within the target DNA is determined by the DNA-targeting RNA In some cases, the kit comprises: (i) a DNA-targeting RNA; and a site-directed modifying polypeptide. In other cases, the kit comprises: (i) a nucleic acid comprising a nucleotide sequence encoding a DNA-targeting RNA; and (ii) a nucleic acid comprising a nucleotide sequence encoding site-directed modifying polypeptide.

The present disclosure provides a kit comprising: (1) a recombinant expression vector comprising (i) a nucleotide sequence encoding a DNA-targeting RNA, wherein the DNA-targeting RNA comprises: (a) a first segment comprising a nucleotide sequence that is complementary to a sequence in a target DNA; and (b) a second segment that interacts with a site-directed modifying polypeptide; and (ii) a nucleotide sequence encoding the site-directed modifying polypeptide, wherein the site-directed modifying polypeptide comprises: (a) an RNA-binding portion that interacts with the DNA-targeting RNA; and (b) an activity portion that exhibits site-directed enzymatic activity, wherein the site of enzymatic activity is determined by the DNA-targeting RNA.; and (2) a reagent for reconstitution and/or dilution of the expression vector.

The present disclosure provides a kit comprising: (1) a recombinant expression vector comprising: (i) a nucleotide sequence encoding a DNA-targeting RNA, wherein the DNA-targeting RNA comprises: (a) a first segment comprising a nucleotide sequence that is complementary to a sequence in a target DNA; and (b) a second segment that interacts with a site-directed modifying polypeptide; and (ii) a nucleotide sequence encoding the site-directed modifying polypeptide, wherein the site-directed modifying polypeptide comprises: (a) an RNA-binding portion that interacts with the DNA-targeting RNA; and (b) an activity portion that modulates transcription within the target DNA, wherein the site of modulated transcription within the target DNA is determined by the DNA-targeting RNA; and (2) a reagent for reconstitution and/or dilution of the recombinant expression vector.

The present disclosure provides a kit comprising: (1) a recombinant expression vector comprising a nucleic acid comprising a nucleotide sequence that encodes a DNA targeting RNA comprising: (i) a first segment comprising a nucleotide sequence that is complementary to a sequence in a target DNA; and (ii) a second segment that interacts with a site-directed modifying polypeptide; and (2) a reagent for reconstitution and/or dilution of the recombinant expression vector. In some embodiments of this kit, the kit comprises: a recombinant expression vector comprising a nucleotide sequence that encodes a site-directed modifying polypeptide, wherein the site-directed modifying polypeptide comprises: (a) an RNA-binding portion that interacts with the DNA-targeting RNA; and (b) an activity portion that exhibits site-directed enzymatic activity, wherein the site of enzymatic activity is determined by the DNA-targeting RNA. In other embodiments of this kit, the kit comprises: a recombinant expression vector comprising a nucleotide sequence that encodes a site-directed modifying polypeptide, wherein the site-directed modifying polypeptide comprises: (a) an RNA-binding portion that interacts with the DNA-targeting RNA; and (b) an activity portion that modulates transcription within the target DNA, wherein the site of modulated transcription within the target DNA is determined by the DNA-targeting RNA.

In some embodiments of any of the above kits, the kit comprises an activator-RNA or a targeter-RNA. In some embodiments of any of the above kits, the kit comprises a single-molecule DNA-targeting RNA. In some embodiments of any of the above kits, the kit comprises two or more double-molecule or single-molecule DNA-targeting RNAs. In some embodiments of any of the above kits, a DNA-targeting RNA (e.g., including two or more DNA-targeting RNAs) can be provided as an array (e.g., an array of RNA molecules, an array of DNA molecules encoding the DNA-targeting RNA(s), etc.). Such kits can be useful, for example, for use in conjunction with the above described genetically modified host cells that comprise a subject site-directed modifying polypeptide. In some embodiments of any of the above kits, the kit further comprises a donor polynucleotide to effect the desired genetic modification. Components of a subject kit can be in separate containers; or can be combined in a single container.

Any of the above-described kits can further include one or more additional reagents, where such additional reagents can be selected from: a dilution buffer; a reconstitution solution; a wash buffer; a control reagent; a control expression vector or RNA polynucleotide; a reagent for in vitro production of the site-directed modifying polypeptide from DNA, and the like.

In addition to above-mentioned components, a subject kit can further include instructions for using the components of the kit to practice the subject methods. The instructions for practicing the subject methods are generally recorded on a suitable recording medium. For example, the instructions may be printed on a substrate, such as paper or plastic, etc. As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, flash drive, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

Non-Human Genetically Modified Organisms

In some embodiments, a genetically modified host cell has been genetically modified with an exogenous nucleic acid comprising a nucleotide sequence encoding a site-directed modifying polypeptide (e.g., a naturally occurring Cas9; a modified, i.e., mutated or variant, Cas9; a chimeric Cas9; etc.). If such a cell is a eukaryotic single-cell organism, then the modified cell can be considered a genetically modified organism. In some embodiments, subject non-human genetically modified organism is a Cas9 transgenic multicellular organism.

In some embodiments, a subject genetically modified non-human host cell (e.g., a cell that has been genetically modified with an exogenous nucleic acid comprising a nucleotide sequence encoding a site-directed modifying polypeptide, e.g., a naturally occurring Cas9; a modified, i.e., mutated or variant, Cas9; a chimeric Cas9; etc.) can generate a subject genetically modified non-human organism (e.g., a mouse, a fish, a frog, a fly, a worm, etc.). For example, if the genetically modified host cell is a pluripotent stem cell (i.e., PSC) or a germ cell (e.g., sperm, oocyte, etc.), an entire genetically modified organism can be derived from the genetically modified host cell. In some embodiments, the genetically modified host cell is a pluripotent stem cell (e.g., ESC, iPSC, pluripotent plant stem cell, etc.) or a germ cell (e.g., sperm cell, oocyte, etc.), either in vivo or in vitro, that can give rise to a genetically modified organism. In some embodiments the genetically modified host cell is a vertebrate PSC (e.g., ESC, iPSC, etc.) and is used to generate a genetically modified organism (e.g. by injecting a PSC into a blastocyst to produce a chimeric/mosaic animal, which could then be mated to generate non-chimeric/non-mosaic genetically modified organisms; grafting in the case of plants; etc.). Any convenient method/protocol for producing a genetically modified organism, including the methods described herein, is suitable for producing a genetically modified host cell comprising an exogenous nucleic acid comprising a nucleotide sequence encoding a site-directed modifying polypeptide (e.g., a naturally occurring Cas9; a modified, i.e., mutated or variant, Cas9; a chimeric Cas9; etc.). Methods of producing genetically modified organisms are known in the art. For example, see Cho et al., Curr Protoc Cell Biol. 2009 March; Chapter 19:Unit 19.11: Generation of transgenic mice; Gama et al., Brain Struct Funct. 2010 March; 214(2-3):91-109. Epub 2009 Nov. 25: Animal transgenesis: an overview; Husaini et al., GM Crops. 2011 June-December; 2(3):150-62. Epub 2011 Jun. 1: Approaches for gene targeting and targeted gene expression in plants.

In some embodiments, a genetically modified organism comprises a target cell for methods of the invention, and thus can be considered a source for target cells. For example, if a genetically modified cell comprising an exogenous nucleic acid comprising a nucleotide sequence encoding a site-directed modifying polypeptide (e.g., a naturally occurring Cas9; a modified, i.e., mutated or variant, Cas9; a chimeric Cas9; etc.) is used to generate a genetically modified organism, then the cells of the genetically modified organism comprise the exogenous nucleic acid comprising a nucleotide sequence encoding a site-directed modifying polypeptide (e.g., a naturally occurring Cas9; a modified, i.e., mutated or variant, Cas9; a chimeric Cas9; etc.). In some such embodiments, the DNA of a cell or cells of the genetically modified organism can be targeted for modification by introducing into the cell or cells a DNA-targeting RNA (or a DNA encoding a DNA-targeting RNA) and optionally a donor nucleic acid. For example, the introduction of a DNA-targeting RNA (or a DNA encoding a DNA-targeting RNA) into a subset of cells (e.g., brain cells, intestinal cells, kidney cells, lung cells, blood cells, etc.) of the genetically modified organism can target the DNA of such cells for modification, the genomic location of which will depend on the DNA-targeting sequence of the introduced DNA-targeting RNA.

In some embodiments, a genetically modified organism is a source of target cells for methods of the invention. For example, a genetically modified organism comprising cells that are genetically modified with an exogenous nucleic acid comprising a nucleotide sequence encoding a site-directed modifying polypeptide (e.g., a naturally occurring Cas9; a modified, i.e., mutated or variant, Cas9; a chimeric Cas9; etc.) can provide a source of genetically modified cells, for example PSCs (e.g., ESCs, iPSCs, sperm, oocytes, etc.), neurons, progenitor cells, cardiomyocytes, etc.

In some embodiments, a genetically modified cell is a PSC comprising an exogenous nucleic acid comprising a nucleotide sequence encoding a site-directed modifying polypeptide (e.g., a naturally occurring Cas9; a modified, i.e., mutated or variant, Cas9; a chimeric Cas9; etc.). As such, the PSC can be a target cell such that the DNA of the PSC can be targeted for modification by introducing into the PSC a DNA-targeting RNA (or a DNA encoding a DNA-targeting RNA) and optionally a donor nucleic acid, and the genomic location of the modification will depend on the DNA-targeting sequence of the introduced DNA-targeting RNA. Thus, in some embodiments, the methods described herein can be used to modify the DNA (e.g., delete and/or replace any desired genomic location) of PSCs derived from a subject genetically modified organism. Such modified PSCs can then be used to generate organisms having both (i) an exogenous nucleic acid comprising a nucleotide sequence encoding a site-directed modifying polypeptide (e.g., a naturally occurring Cas9; a modified, i.e., mutated or variant, Cas9; a chimeric Cas9; etc.) and (ii) a DNA modification that was introduced into the PSC.

An exogenous nucleic acid comprising a nucleotide sequence encoding a site-directed modifying polypeptide (e.g., a naturally occurring Cas9; a modified, i.e., mutated or variant, Cas9; a chimeric Cas9; etc.) can be under the control of (i.e., operably linked to) an unknown promoter (e.g., when the nucleic acid randomly integrates into a host cell genome) or can be under the control of (i.e., operably linked to) a known promoter. Suitable known promoters can be any known promoter and include constitutively active promoters (e.g., CMV promoter), inducible promoters (e.g., heat shock promoter, Tetracycline-regulated promoter, Steroid-regulated promoter, Metal-regulated promoter, estrogen receptor-regulated promoter, etc.), spatially restricted and/or temporally restricted promoters (e.g., a tissue specific promoter, a cell type specific promoter, etc.), etc.

A subject genetically modified organism (e.g. an organism whose cells comprise a nucleotide sequence encoding a site-directed modifying polypeptide, e.g., a naturally occurring Cas9; a modified, i.e., mutated or variant, Cas9; a chimeric Cas9; etc.) can be any organism including for example, a plant; algae; an invertebrate (e.g., a cnidarian, an echinoderm, a worm, a fly, etc.); a vertebrate (e.g., a fish (e.g., zebrafish, puffer fish, gold fish, etc.), an amphibian (e.g., salamander, frog, etc.), a reptile, a bird, a mammal, etc.); an ungulate (e.g., a goat, a pig, a sheep, a cow, etc.); a rodent (e.g., a mouse, a rat, a hamster, a guinea pig); a lagomorpha (e.g., a rabbit); etc.

In some cases, the site-directed modifying polypeptide comprises an amino acid sequence having at least about 75%, at least about 80%, at least about 85%, at least about 90%, at least about 95%, at least about 99%, or 100%, amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346.

Transgenic Non-Human Animals

As described above, in some embodiments, a subject nucleic acid (e.g., a nucleotide sequence encoding a site-directed modifying polypeptide, e.g., a naturally occurring Cas9; a modified, i.e., mutated or variant, Cas9; a chimeric Cas9; etc.) or a subject recombinant expression vector is used as a transgene to generate a transgenic animal that produces a site-directed modifying polypeptide. Thus, the present invention further provides a transgenic non-human animal, which animal comprises a transgene comprising a subject nucleic acid comprising a nucleotide sequence encoding a site-directed modifying polypeptide, e.g., a naturally occurring Cas9; a modified, i.e., mutated or variant, Cas9; a chimeric Cas9; etc., as described above. In some embodiments, the genome of the transgenic non-human animal comprises a subject nucleotide sequence encoding a site-directed modifying polypeptide. In some embodiments, the transgenic non-human animal is homozygous for the genetic modification. In some embodiments, the transgenic non-human animal is heterozygous for the genetic modification. In some embodiments, the transgenic non-human animal is a vertebrate, for example, a fish (e.g., zebra fish, gold fish, puffer fish, cave fish, etc.), an amphibian (frog, salamander, etc.), a bird (e.g., chicken, turkey, etc.), a reptile (e.g., snake, lizard, etc.), a mammal (e.g., an ungulate, e.g., a pig, a cow, a goat, a sheep, etc.; a lagomorph (e.g., a rabbit); a rodent (e.g., a rat, a mouse); a non-human primate; etc.), etc.

An exogenous nucleic acid comprising a nucleotide sequence encoding a site-directed modifying polypeptide (e.g., a naturally occurring Cas9; a modified, i.e., mutated or variant, Cas9; a chimeric Cas9; etc.) can be under the control of (i.e., operably linked to) an unknown promoter (e.g., when the nucleic acid randomly integrates into a host cell genome) or can be under the control of (i.e., operably linked to) a known promoter. Suitable known promoters can be any known promoter and include constitutively active promoters (e.g., CMV promoter), inducible promoters (e.g., heat shock promoter, Tetracycline-regulated promoter, Steroid-regulated promoter, Metal-regulated promoter, estrogen receptor-regulated promoter, etc.), spatially restricted and/or temporally restricted promoters (e.g., a tissue specific promoter, a cell type specific promoter, etc.), etc.

In some cases, the site-directed modifying polypeptide comprises an amino acid sequence having at least about 75%, at least about 80%, at least about 85%, at least about 90%, at least about 95%, at least about 99%, or 100%, amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346.

Transgenic Plants

As described above, in some embodiments, a subject nucleic acid (e.g., a nucleotide sequence encoding a site-directed modifying polypeptide, e.g., a naturally occurring Cas9; a modified, i.e., mutated or variant, Cas9; a chimeric Cas9; etc.) or a subject recombinant expression vector is used as a transgene to generate a transgenic plant that produces a site-directed modifying polypeptide. Thus, the present invention further provides a transgenic plant, which plant comprises a transgene comprising a subject nucleic acid comprising a nucleotide sequence encoding site-directed modifying polypeptide, e.g., a naturally occurring Cas9; a modified, i.e., mutated or variant, Cas9; a chimeric Cas9; etc., as described above. In some embodiments, the genome of the transgenic plant comprises a subject nucleic acid. In some embodiments, the transgenic plant is homozygous for the genetic modification. In some embodiments, the transgenic plant is heterozygous for the genetic modification.

Methods of introducing exogenous nucleic acids into plant cells are well known in the art. Such plant cells are considered "transformed," as defined above. Suitable methods include viral infection (such as double stranded DNA viruses), transfection, conjugation, protoplast fusion, electroporation, particle gun technology, calcium phosphate precipitation, direct microinjection, silicon carbide whiskers technology, *Agrobacterium*-mediated transformation and the like. The choice of method is generally dependent on the type of cell being transformed and the circumstances under which the transformation is taking place (i.e. in vitro, ex vivo, or in vivo).

Transformation methods based upon the soil bacterium *Agrobacterium tumefaciens* are particularly useful for introducing an exogenous nucleic acid molecule into a vascular plant. The wild type form of *Agrobacterium* contains a Ti (tumor-inducing) plasmid that directs production of tumorigenic crown gall growth on host plants. Transfer of the tumor-inducing T-DNA region of the Ti plasmid to a plant genome requires the Ti plasmid-encoded virulence genes as well as T-DNA borders, which are a set of direct DNA repeats that delineate the region to be transferred. An *Agrobacterium*-based vector is a modified form of a Ti plasmid, in which the tumor inducing functions are replaced by the nucleic acid sequence of interest to be introduced into the plant host.

*Agrobacterium*-mediated transformation generally employs cointegrate vectors or binary vector systems, in which the components of the Ti plasmid are divided between a helper vector, which resides permanently in the *Agrobacterium* host and carries the virulence genes, and a shuttle vector, which contains the gene of interest bounded by T-DNA sequences. A variety of binary vectors are well known in the art and are commercially available, for example, from Clontech (Palo Alto, Calif.). Methods of coculturing *Agrobacterium* with cultured plant cells or wounded tissue such as leaf tissue, root explants, hypocotyledons, stem pieces or tubers, for example, also are well known in the art. See., e.g., Glick and Thompson, (eds.), *Methods in Plant Molecular Biology and Biotechnology*, Boca Raton, Fla.: CRC Press (1993).

Microprojectile-mediated transformation also can be used to produce a subject transgenic plant. This method, first described by Klein et al. (*Nature* 327:70-73 (1987)), relies on microprojectiles such as gold or tungsten that are coated with the desired nucleic acid molecule by precipitation with calcium chloride, spermidine or polyethylene glycol. The microprojectile particles are accelerated at high speed into an angiosperm tissue using a device such as the BIOLISTIC PD-1000 (Biorad; Hercules Calif.).

A subject nucleic acid may be introduced into a plant in a manner such that the nucleic acid is able to enter a plant cell(s), e.g., via an in vivo or ex vivo protocol. By "in vivo," it is meant in the nucleic acid is administered to a living body of a plant e.g. infiltration. By "ex vivo" it is meant that cells or explants are modified outside of the plant, and then such cells or organs are regenerated to a plant. A number of vectors suitable for stable transformation of plant cells or for the establishment of transgenic plants have been described, including those described in Weissbach and Weissbach, (1989) Methods for Plant Molecular Biology Academic Press, and Gelvin et al., (1990) Plant Molecular Biology Manual, Kluwer Academic Publishers. Specific examples include those derived from a Ti plasmid of *Agrobacterium tumefaciens*, as well as those disclosed by Herrera-Estrella et al. (1983) Nature 303: 209, Bevan (1984) Nucl Acid Res. 12: 8711-8721, Klee (1985) Bio/Technolo 3: 637-642. Alternatively, non-Ti vectors can be used to transfer the DNA into plants and cells by using free DNA delivery techniques. By using these methods transgenic plants such as wheat, rice (Christou (1991) Bio/Technology 9:957-9 and 4462) and corn (Gordon-Kamm (1990) Plant Cell 2: 603-618) can be produced. An immature embryo can also be a good target tissue for monocots for direct DNA delivery techniques by using the particle gun (Weeks et al. (1993) Plant Physiol 102: 1077-1084; Vasil (1993) Bio/Technolo 10: 667-674; Wan and Lemeaux (1994) Plant Physiol 104: 37-48 and for *Agrobacterium*-mediated DNA transfer (Ishida et al. (1996) Nature Biotech 14: 745-750). Exemplary methods for introduction of DNA into chloroplasts are biolistic bombardment, polyethylene glycol transformation of protoplasts, and microinjection (Danieli et al Nat. Biotechnol 16:345-348, 1998; Staub et al Nat. Biotechnol 18: 333-338, 2000; O'Neill et al Plant J. 3:729-738, 1993; Knoblauch et al Nat. Biotechnol 17: 906-909; U.S. Pat. Nos. 5,451,513, 5,545, 817, 5,545,818, and 5,576,198; in Intl. Application No. WO 95/16783; and in Boynton et al., Methods in Enzymology 217: 510-536 (1993), Svab et al., Proc. Natl. Acad. Sci. USA 90: 913-917 (1993), and McBride et al., Proc. Nati. Acad. Sci. USA 91: 7301-7305 (1994)). Any vector suitable for the methods of biolistic bombardment, polyethylene glycol transformation of protoplasts and microinjection will be suitable as a targeting vector for chloroplast transformation. Any double stranded DNA vector may be used as a transformation vector, especially when the method of introduction does not utilize *Agrobacterium*.

Plants which can be genetically modified include grains, forage crops, fruits, vegetables, oil seed crops, palms, forestry, and vines. Specific examples of plants which can be modified follow: maize, banana, peanut, field peas, sunflower, tomato, canola, tobacco, wheat, barley, oats, potato, soybeans, cotton, carnations, sorghum, lupin and rice.

Also provided by the subject invention are transformed plant cells, tissues, plants and products that contain the transformed plant cells. A feature of the subject transformed cells, and tissues and products that include the same is the presence of a subject nucleic acid integrated into the genome, and production by plant cells of a site-directed modifying polypeptide, e.g., a naturally occurring Cas9; a modified, i.e., mutated or variant, Cas9; a chimeric Cas9; etc. Recombinant plant cells of the present invention are useful as populations of recombinant cells, or as a tissue, seed, whole plant, stem, fruit, leaf, root, flower, stem, tuber, grain, animal feed, a field of plants, and the like.

A nucleic acid comprising a nucleotide sequence encoding a site-directed modifying polypeptide (e.g., a naturally occurring Cas9; a modified, i.e., mutated or variant, Cas9; a chimeric Cas9; etc.) can be under the control of (i.e., operably linked to) an unknown promoter (e.g., when the nucleic acid randomly integrates into a host cell genome) or can be under the control of (i.e., operably linked to) a known promoter. Suitable known promoters can be any known promoter and include constitutively active promoters, inducible promoters, spatially restricted and/or temporally restricted promoters, etc.

In some cases, the site-directed modifying polypeptide comprises an amino acid sequence having at least about 75%, at least about 80%, at least about 85%, at least about 90%, at least about 95%, at least about 99%, or 100%, amino acid sequence identity to amino acids 7-166 or 731-1003 of the Cas9/Csn1 amino acid sequence depicted in FIG. 3A and FIG. 3B, or to the corresponding portions in any of the amino acid sequences set forth as SEQ ID NOs:1-256 and 795-1346.

Also provided by the subject invention is reproductive material of a subject transgenic plant, where reproductive material includes seeds, progeny plants and clonal material.

Definitions—Part II

The term "naturally-occurring" or "unmodified" as used herein as applied to a nucleic acid, a polypeptide, a cell, or an organism, refers to a nucleic acid, polypeptide, cell, or organism that is found in nature. For example, a polypeptide or polynucleotide sequence that is present in an organism (including viruses) that can be isolated from a source in nature and which has not been intentionally modified by a human in the laboratory is naturally occurring.

"Heterologous," as used herein, means a nucleotide or polypeptide sequence that is not found in the native nucleic acid or protein, respectively. For example, in a fusion variant Cas9 site-directed polypeptide, a variant Cas9 site-directed polypeptide may be fused to a heterologous polypeptide (i.e. a polypeptide other than Cas9). The heterologous polypeptide may exhibit an activity (e.g., enzymatic activity) that will also be exhibited by the fusion variant Cas9 site-directed polypeptide. A heterologous nucleic acid sequence may be linked to a variant Cas9 site-directed polypeptide (e.g., by genetic engineering) to generate a nucleotide sequence encoding a fusion variant Cas9 site-directed polypeptide.

The term "chimeric polypeptide" refers to a polypeptide which is not naturally occurring, e.g., is made by the artificial combination of two otherwise separated segments of amino sequence through human intervention. Thus, a chimeric polypeptide is also the result of human intervention. Thus, a polypeptide that comprises a chimeric amino acid sequence is a chimeric polypeptide.

By "site-directed polypeptide" or "RNA-binding site-directed polypeptide" or "RNA-binding site-directed polypeptide" it is meant a polypeptide that binds RNA and is targeted to a specific DNA sequence. A site-directed polypeptide as described herein is targeted to a specific DNA sequence by the RNA molecule to which it is bound. The RNA molecule comprises a sequence that is complementary to a target sequence within the target DNA, thus targeting the bound polypeptide to a specific location within the target DNA (the target sequence).

In some embodiments, a subject nucleic acid (e.g., a DNA-targeting RNA, a nucleic acid comprising a nucleotide sequence encoding a DNA-targeting RNA; a nucleic acid encoding a site-directed polypeptide; etc.) comprises a modification or sequence that provides for an additional desirable feature (e.g., modified or regulated stability; subcellular targeting; tracking, e.g., a fluorescent label; a binding site for a protein or protein complex; etc.). Non-limiting examples include: a 5' cap (e.g., a 7-methylguanylate cap ($m^7G$)); a 3' polyadenylated tail (i.e., a 3' poly(A) tail); a riboswitch sequence (e.g., to allow for regulated stability and/or regulated accessibility by proteins and/or protein complexes); a modification or sequence that targets the RNA to a subcellular location (e.g., nucleus, mitochondria, chloroplasts, and the like); a modification or sequence that provides for tracking (e.g., direct conjugation to a fluorescent molecule, conjugation to a moiety that facilitates fluorescent detection, a sequence that allows for fluorescent detection, etc.); a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like); and combinations thereof.

In some embodiments, a DNA-targeting RNA comprises an additional segment at either the 5' or 3' end that provides for any of the features described above. For example, a suitable third segment can comprise a 5' cap (e.g., a 7-methylguanylate cap ($m^7G$)); a 3' polyadenylated tail (i.e., a 3' poly(A) tail); a riboswitch sequence (e.g., to allow for regulated stability and/or regulated accessibility by proteins and protein complexes); a sequence that targets the RNA to a subcellular location (e.g., nucleus, mitochondria, chloroplasts, and the like); a modification or sequence that provides for tracking (e.g., direct conjugation to a fluorescent molecule, conjugation to a moiety that facilitates fluorescent detection, a sequence that allows for fluorescent detection, etc.); a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like); and combinations thereof.

A subject DNA-targeting RNA and a subject site-directed polypeptide form a complex (i.e., bind via non-covalent interactions). The DNA-targeting RNA provides target specificity to the complex by comprising a nucleotide sequence that is complementary to a sequence of a target DNA. The site-directed polypeptide of the complex provides the site-specific activity. In other words, the site-directed polypeptide is guided to a target DNA sequence (e.g. a target sequence in a chromosomal nucleic acid; a target sequence in an extrachromosomal nucleic acid, e.g. an episomal nucleic acid, a minicircle, etc.; a target sequence in a mitochondrial nucleic acid; a target sequence in a chloroplast nucleic acid; a target sequence in a plasmid; etc.) by virtue of its association with the protein-binding segment of the DNA-targeting RNA.

In some embodiments, a subject DNA-targeting RNA comprises two separate RNA molecules (RNA polynucleotides) and is referred to herein as a "double-molecule DNA-targeting RNA" or a "two-molecule DNA-targeting RNA." In other embodiments, a subject DNA-targeting RNA is a single RNA molecule (single RNA polynucleotide) and is referred to herein as a "single-molecule DNA-targeting RNA.". If not otherwise specified, the term "DNA-targeting RNA" is inclusive, referring to both single-molecule DNA-targeting RNAs and double-molecule DNA-targeting RNAs.

A subject two-molecule DNA-targeting RNA comprises two separate RNA molecules (a "targeter-RNA" and an "activator-RNA"). Each of the two RNA molecules of a subject two-molecule DNA-targeting RNA comprises a stretch of nucleotides that are complementary to one another such that the complementary nucleotides of the two RNA molecules hybridize to form the double stranded RNA duplex of the protein-binding segment.

A subject single-molecule DNA-targeting RNA comprises two stretches of nucleotides (a targeter-RNA and an activator-RNA) that are complementary to one another, are covalently linked by intervening nucleotides ("linkers" or "linker nucleotides"), and hybridize to form the double stranded RNA duplex (dsRNA duplex) of the protein-binding segment, thus resulting in a stem-loop structure. The targeter-RNA and the activator-RNA can be covalently linked via the 3' end of the targeter-RNA and the 5' end of the activator-RNA. Alternatively, targeter-RNA and the activator-RNA can be covalently linked via the 5' end of the targeter-RNA and the 3' end of the activator-RNA.

An exemplary two-molecule DNA-targeting RNA comprises a crRNA-like ("CRISPR RNA" or "targeter-RNA" or "crRNA" or "crRNA repeat") molecule and a corresponding tracrRNA-like ("trans-acting CRISPR RNA" or "activator-RNA" or "tracrRNA") molecule. A crRNA-like molecule (targeter-RNA) comprises both the DNA-targeting segment (single stranded) of the DNA-targeting RNA and a stretch ("duplex-forming segment") of nucleotides that forms one half of the dsRNA duplex of the protein-binding segment of the DNA-targeting RNA. A corresponding tracrRNA-like molecule (activator-RNA) comprises a stretch of nucleotides (duplex-forming segment) that forms the other half of the dsRNA duplex of the protein-binding segment of the DNA-targeting RNA. In other words, a stretch of nucleotides of a crRNA-like molecule are complementary to and hybridize with a stretch of nucleotides of a tracrRNA-like molecule to form the dsRNA duplex of the protein-binding domain of the DNA-targeting RNA. As such, each crRNA-like molecule can be said to have a corresponding tracrRNA-like molecule. The crRNA-like molecule additionally provides the single stranded DNA-targeting segment. Thus, a crRNA-like and a tracrRNA-like molecule (as a corresponding pair) hybridize to form a DNA-targeting RNA. The exact sequence of a given crRNA or tracrRNA molecule is characteristic of the species in which the RNA molecules are found.

The term "activator-RNA" is used herein to mean a tracrRNA-like molecule of a double-molecule DNA-targeting RNA. The term "targeter-RNA" is used herein to mean a crRNA-like molecule of a double-molecule DNA-targeting RNA. The term "duplex-forming segment" is used herein to mean the stretch of nucleotides of an activator-RNA or a targeter-RNA that contributes to the formation of the dsRNA duplex by hybridizing to a stretch of nucleotides of a corresponding activator-RNA or targeter-RNA molecule. In other words, an activator-RNA comprises a duplex-forming segment that is complementary to the duplex-forming segment of the corresponding targeter-RNA. As such, an activator-RNA comprises a duplex-forming segment while a targeter-RNA comprises both a duplex-forming segment and the DNA-targeting segment of the DNA-targeting RNA. Therefore, a subject double-molecule DNA-targeting RNA can be comprised of any corresponding activator-RNA and targeter-RNA pair.

A two-molecule DNA-targeting RNA can be designed to allow for controlled (i.e., conditional) binding of a targeter-RNA with an activator-RNA. Because a two-molecule DNA-targeting RNA is not functional unless both the activator-RNA and the targeter-RNA are bound in a functional complex with dCas9, a two-molecule DNA-targeting RNA can be inducible (e.g., drug inducible) by rendering the binding between the activator-RNA and the targeter-RNA to be inducible. As one non-limiting example, RNA aptamers can be used to regulate (i.e., control) the binding of the activator-RNA with the targeter-RNA. Accordingly, the activator-RNA and/or the targeter-RNA can comprise an RNA aptamer sequence.

RNA aptamers are known in the art and are generally a synthetic version of a riboswitch. The terms "RNA aptamer" and "riboswitch" are used interchangeably herein to encompass both synthetic and natural nucleic acid sequences that provide for inducible regulation of the structure (and therefore the availability of specific sequences) of the RNA molecule of which they are part. RNA aptamers usually comprise a sequence that folds into a particular structure (e.g., a hairpin), which specifically binds a particular drug (e.g., a small molecule). Binding of the drug causes a structural change in the folding of the RNA, which changes a feature of the nucleic acid of which the aptamer is a part. As non-limiting examples: (i) an activator-RNA with an aptamer may not be able to bind to the cognate targeter-RNA unless the aptamer is bound by the appropriate drug; (ii) a targeter-RNA with an aptamer may not be able to bind to the cognate activator-RNA unless the aptamer is bound by the appropriate drug; and (iii) a targeter-RNA and an activator-RNA, each comprising a different aptamer that binds a different drug, may not be able to bind to each other unless both drugs are present. As illustrated by these examples, a two-molecule DNA-targeting RNA can be designed to be inducible.

Examples of aptamers and riboswitches can be found, for example, in: Nakamura et al., Genes Cells. 2012 May; 17(5):344-64; Vavalle et al., Future Cardiol. 2012 May; 8(3):371-82; Citartan et al., Biosens Bioelectron. 2012 Apr. 15; 34(1):1-11; and Liberman et al., Wiley Interdiscip Rev RNA. 2012 May-June; 3(3):369-84; all of which are herein incorporated by reference in their entirety.

Non-limiting examples of nucleotide sequences that can be included in a two-molecule DNA-targeting RNA include targeter RNAs (e.g., SEQ ID NOs:566-567) that can pair with the duplex forming segment of any one of the activator RNAs set forth in SEQ ID NOs:671-678.

An exemplary single-molecule DNA-targeting RNA comprises two complementary stretches of nucleotides that hybridize to form a dsRNA duplex. In some embodiments, one of the two complementary stretches of nucleotides of the single-molecule DNA-targeting RNA (or the DNA encoding the stretch) is at least about 60% identical to one of the activator-RNA (tracrRNA) sequences set forth in SEQ ID NOs:431-562 over a stretch of at least 8 contiguous nucleotides. For example, one of the two complementary stretches of nucleotides of the single-molecule DNA-targeting RNA (or the DNA encoding the stretch) is at least about 65% identical, at least about 70% identical, at least about 75% identical, at least about 80% identical, at least about 85% identical, at least about 90% identical, at least about 95% identical, at least about 98% identical, at least about 99% identical or 100% identical to one of the tracrRNA sequences set forth in SEQ ID NOs:431-562 over a stretch of at least 8 contiguous nucleotides.

In some embodiments, one of the two complementary stretches of nucleotides of the single-molecule DNA-targeting RNA (or the DNA encoding the stretch) is at least about 60% identical to one of the targeter-RNA (crRNA) sequences set forth in SEQ ID NOs:563-679 over a stretch of at least 8 contiguous nucleotides. For example, one of the two complementary stretches of nucleotides of the single-molecule DNA-targeting RNA (or the DNA encoding the stretch) is at least about 65% identical, at least about 70% identical, at least about 75% identical, at least about 80% identical, at least about 85% identical, at least about 90% identical, at least about 95% identical, at least about 98% identical, at least about 99% identical or 100% identical to one of the crRNA sequences set forth in SEQ ID NOs:563-679 over a stretch of at least 8 contiguous nucleotides.

As above, a "host cell," as used herein, denotes an in vivo or in vitro eukaryotic cell, a prokaryotic cell (e.g., bacterial or archaeal cell), or a cell from a multicellular organism (e.g., a cell line) cultured as a unicellular entity, which eukaryotic or prokaryotic cells can be, or have been, used as recipients for a nucleic acid, and include the progeny of the original cell which has been transformed by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector. For example, a subject bacterial host cell is a genetically modified bacterial host cell by virtue of introduction into a suitable bacterial host cell of an exogenous nucleic acid (e.g., a plasmid or recombinant expression vector) and a subject eukaryotic host cell is a genetically modified eukaryotic host cell (e.g., a mammalian germ cell), by virtue of introduction into a suitable eukaryotic host cell of an exogenous nucleic acid.

Definitions provided in "Definitions—Part I" are also applicable to the instant section; see "Definitions—Part I" for additional clarification of terms.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "an enzymatically inactive Cas9 polypeptide" includes a plurality of such polypeptides and reference to "the target nucleic acid" includes reference to one or more target nucleic acids and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

Detailed Description—Part II

The present disclosure provides methods of modulating transcription of a target nucleic acid in a host cell. The methods generally involve contacting the target nucleic acid with an enzymatically inactive Cas9 polypeptide and a single-guide RNA. The methods are useful in a variety of applications, which are also provided.

A transcriptional modulation method of the present disclosure overcomes some of the drawbacks of methods involving RNAi. A transcriptional modulation method of the present disclosure finds use in a wide variety of applications, including research applications, drug discovery (e.g., high throughput screening), target validation, industrial applications (e.g., crop engineering; microbial engineering, etc.), diagnostic applications, therapeutic applications, and imaging techniques.

Methods of Modulating Transcription

The present disclosure provides a method of selectively modulating transcription of a target DNA in a host cell. The method generally involves: a) introducing into the host cell: i) a DNA-targeting RNA, or a nucleic acid comprising a nucleotide sequence encoding the DNA-targeting RNA; and ii) a variant Cas9 site-directed polypeptide ("variant Cas9 polypeptide"), or a nucleic acid comprising a nucleotide sequence encoding the variant Cas9 polypeptide, where the variant Cas9 polypeptide exhibits reduced endodeoxyribonuclease activity.

The DNA-targeting RNA (also referred to herein as "crRNA"; or "guide RNA"; or "gRNA") comprises: i) a first segment comprising a nucleotide sequence that is complementary to a target sequence in a target DNA; ii) a second segment that interacts with a site-directed polypeptide; and iii) a transcriptional terminator. The first segment, comprising a nucleotide sequence that is complementary to a target sequence in a target DNA, is referred to herein as a "targeting segment". The second segment, which interacts with a site-directed polypeptide, is also referred to herein as a "protein-binding sequence" or "dCas9-binding hairpin," or "dCas9 handle." By "segment" it is meant a segment/section/region of a molecule, e.g., a contiguous stretch of nucleotides in an RNA. The definition of "segment," unless otherwise specifically defined in a particular context, is not limited to a specific number of total base pairs, and may include regions of RNA molecules that are of any total length and may or may not include regions with complementarity to other molecules. A DNA-targeting RNA according to the present disclosure can be a single RNA molecule (single RNA polynucleotide), which can be referred to herein as a "single-molecule DNA-targeting RNA," a "single-guide RNA," or an "sgRNA." A DNA-targeting RNA according to the present disclosure can comprise two RNA molecules. The term "DNA-targeting RNA" or "gRNA" is inclusive, referring both to two-molecule DNA-targeting RNAs and to single-molecule DNA-targeting RNAs (i.e., sgRNAs).

The variant Cas9 site-directed polypeptide comprises: i) an RNA-binding portion that interacts with the DNA-targeting RNA; and ii) an activity portion that exhibits reduced endodeoxyribonuclease activity.

The DNA-targeting RNA and the variant Cas9 polypeptide form a complex in the host cell; the complex selectively modulates transcription of a target DNA in the host cell.

In some cases, a transcription modulation method of the present disclosure provides for selective modulation (e.g., reduction or increase) of a target nucleic acid in a host cell. For example, "selective" reduction of transcription of a target nucleic acid reduces transcription of the target nucleic acid by at least about 10%, at least about 20%, at least about 30%, at least about 40%, at least about 50%, at least about 60%, at least about 70%, at least about 80%, at least about 90%, or greater than 90%, compared to the level of transcription of the target nucleic acid in the absence of a DNA-targeting RNA/variant Cas9 polypeptide complex. Selective reduction of transcription of a target nucleic acid reduces transcription of the target nucleic acid, but does not substantially reduce transcription of a non-target nucleic acid, e.g., transcription of a non-target nucleic acid is reduced, if at all, by less than 10% compared to the level of transcription of the non-target nucleic acid in the absence of the DNA-targeting RNA/variant Cas9 polypeptide complex.

Increased Transcription

"Selective" increased transcription of a target DNA can increase transcription of the target DNA by at least about 1.1 fold (e.g., at least about 1.2 fold, at least about 1.3 fold, at least about 1.4 fold, at least about 1.5 fold, at least about 1.6 fold, at least about 1.7 fold, at least about 1.8 fold, at least about 1.9 fold, at least about 2 fold, at least about 2.5 fold, at least about 3 fold, at least about 3.5 fold, at least about 4 fold, at least about 4.5 fold, at least about 5 fold, at least about 6 fold, at least about 7 fold, at least about 8 fold, at least about 9 fold, at least about 10 fold, at least about 12 fold, at least about 15 fold, or at least about 20-fold) compared to the level of transcription of the target DNA in the absence of a DNA-targeting RNA/variant Cas9 polypeptide complex. Selective increase of transcription of a target DNA increases transcription of the target DNA, but does not substantially increase transcription of a non-target DNA, e.g., transcription of a non-target DNA is increased, if at all, by less than about 5-fold (e.g., less than about 4-fold, less than about 3-fold, less than about 2-fold, less than about 1.8-fold, less than about 1.6-fold, less than about 1.4-fold, less than about 1.2-fold, or less than about 1.1-fold) compared to the level of transcription of the non-targeted DNA in the absence of the DNA-targeting RNA/variant Cas9 polypeptide complex.

As a non-limiting example, increased can be achieved by fusing dCas9 to a heterologous sequence. Suitable fusion partners include, but are not limited to, a polypeptide that provides an activity that indirectly increases transcription by acting directly on the target DNA or on a polypeptide (e.g., a histone or other DNA-binding protein) associated with the target DNA. Suitable fusion partners include, but are not limited to, a polypeptide that provides for methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, or demyristoylation activity.

Additional suitable fusion partners include, but are not limited to, a polypeptide that directly provides for increased transcription of the target nucleic acid (e.g., a transcription activator or a fragment thereof, a protein or fragment thereof that recruits a transcription activator, a small molecule/drug-responsive transcription regulator, etc.).

A non-limiting example of a subject method using a dCas9 fusion protein to increase transcription in a prokaryote includes a modification of the bacterial one-hybrid (B1H) or two-hybrid (B2H) system. In the B1H system, a DNA binding domain (BD) is fused to a bacterial transcription activation domain (AD, e.g., the alpha subunit of the *Escherichia coli* RNA polymerase (RNAPα)). Thus, a subject dCas9 can be fused to a heterologous sequence comprising an AD. When the subject dCas9 fusion protein arrives at the upstream region of a promoter (targeted there by the DNA-targeting RNA) the AD (e.g., RNAPα) of the dCas9 fusion protein recruits the RNAP holoenzyme, leading to transcription activation. In the B2H system, the BD is not directly fused to the AD; instead, their interaction is mediated by a protein-protein interaction (e.g., GAL11P-GAL4 interaction). To modify such a system for use in the subject methods, dCas9 can be fused to a first protein sequence that provides for protein-protein interaction (e.g., the yeast GAL11P and/or GAL4 protein) and RNAα can be fused to a second protein sequence that completes the protein-protein interaction (e.g., GAL4 if GAL11P is fused to dCas9, GAL11P if GAL4 is fused to dCas9, etc.). The binding affinity between GAL11P and GAL4 increases the efficiency of binding and transcription firing rate.

A non-limiting example of a subject method using a dCas9 fusion protein to increase transcription in a eukaryotes includes fusion of dCas9 to an activation domain (AD) (e.g., GAL4, herpesvirus activation protein VP16 or VP64, human nuclear factor NF-κB p65 subunit, etc.). To render the system inducible, expression of the dCas9 fusion protein can be controlled by an inducible promoter (e.g., Tet-ON, Tet-OFF, etc.). The DNA-targeting RNA can be design to target known transcription response elements (e.g., promoters, enhancers, etc.), known upstream activating sequences (UAS), sequences of unknown or known function that are suspected of being able to control expression of the target DNA, etc.

Additional Fusion Partners

Non-limiting examples of fusion partners to accomplish increased or decreased transcription are listed in FIGS. 54A-54C and include transcription activator and transcription repressor domains (e.g., the Krüppel associated box (KRAB or SKD); the Mad mSIN3 interaction domain (SID); the ERF repressor domain (ERD), etc). In some such cases, the dCas9 fusion protein is targeted by the DNA-targeting RNA to a specific location (i.e., sequence) in the target DNA and exerts locus-specific regulation such as blocking RNA polymerase binding to a promoter (which selectively inhibits transcription activator function), and/or modifying the local chromatin status (e.g., when a fusion sequence is used that modifies the target DNA or modifies a polypeptide associated with the target DNA). In some cases, the changes are transient (e.g., transcription repression or activation). In some cases, the changes are inheritable (e.g., when epigenetic modifications are made to the target DNA or to proteins associated with the target DNA, e.g., nucleosomal histones).

In some embodiments, the heterologous sequence can be fused to the C-terminus of the dCas9 polypeptide. In some embodiments, the heterologous sequence can be fused to the N-terminus of the dCas9 polypeptide. In some embodiments, the heterologous sequence can be fused to an internal portion (i.e., a portion other than the N- or C-terminus) of the dCas9 polypeptide.

The biological effects of a method using a subject dCas9 fusion protein can be detected by any convenient method (e.g., gene expression assays; chromatin-based assays, e.g., Chromatin immunoPrecipitation (ChiP), Chromatin in vivo Assay (CiA), etc.; and the like).

In some cases, a subject method involves use of two or more different DNA-targeting RNAs. For example, two different DNA-targeting RNAs can be used in a single host cell, where the two different DNA-targeting RNAs target two different target sequences in the same target nucleic acid.

Thus, for example, a subject transcriptional modulation method can further comprise introducing into the host cell a second DNA-targeting RNA, or a nucleic acid comprising a nucleotide sequence encoding the second DNA-targeting RNA, where the second DNA-targeting RNA comprises: i)

a first segment comprising a nucleotide sequence that is complementary to a second target sequence in the target DNA; ii) a second segment that interacts with the site-directed polypeptide; and iii) a transcriptional terminator. In some cases, use of two different DNA-targeting RNAs targeting two different targeting sequences in the same target nucleic acid provides for increased modulation (e.g., reduction or increase) in transcription of the target nucleic acid.

As another example, two different DNA-targeting RNAs can be used in a single host cell, where the two different DNA-targeting RNAs target two different target nucleic acids. Thus, for example, a subject transcriptional modulation method can further comprise introducing into the host cell a second DNA-targeting RNA, or a nucleic acid comprising a nucleotide sequence encoding the second DNA-targeting RNA, where the second DNA-targeting RNA comprises: i) a first segment comprising a nucleotide sequence that is complementary to a target sequence in at least a second target DNA; ii) a second segment that interacts with the site-directed polypeptide; and iii) a transcriptional terminator.

In some embodiments, a subject nucleic acid (e.g., a DNA-targeting RNA, e.g., a single-molecule DNA-targeting RNA, an activator-RNA, a targeter-RNA, etc.; a donor polynucleotide; a nucleic acid encoding a site-directed modifying polypeptide; etc.) comprises a modification or sequence that provides for an additional desirable feature (e.g., modified or regulated stability; subcellular targeting; tracking, e.g., a fluorescent label; a binding site for a protein or protein complex; etc.). Non-limiting examples include: a 5' cap (e.g., a 7-methylguanylate cap ($m^7G$)); a 3' polyadenylated tail (i.e., a 3' poly(A) tail); a riboswitch sequence or an aptamer sequence (e.g., to allow for regulated stability and/or regulated accessibility by proteins and/or protein complexes); a terminator sequence; a sequence that forms a dsRNA duplex (i.e., a hairpin)); a modification or sequence that targets the RNA to a subcellular location (e.g., nucleus, mitochondria, chloroplasts, and the like); a modification or sequence that provides for tracking (e.g., direct conjugation to a fluorescent molecule, conjugation to a moiety that facilitates fluorescent detection, a sequence that allows for fluorescent detection, etc.); a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like); and combinations thereof.

DNA-Targeting Segment

The DNA-targeting segment (or "DNA-targeting sequence") of a DNA-targeting RNA ("crRNA") comprises a nucleotide sequence that is complementary to a specific sequence within a target DNA (the complementary strand of the target DNA).

In other words, the DNA-targeting segment of a subject DNA-targeting RNA interacts with a target DNA in a sequence-specific manner via hybridization (i.e., base pairing). As such, the nucleotide sequence of the DNA-targeting segment may vary and determines the location within the target DNA that the DNA-targeting RNA and the target DNA will interact. The DNA-targeting segment of a subject DNA-targeting RNA can be modified (e.g., by genetic engineering) to hybridize to any desired sequence within a target DNA.

The DNA-targeting segment can have a length of from about 12 nucleotides to about 100 nucleotides. For example, the DNA-targeting segment can have a length of from about 12 nucleotides (nt) to about 80 nt, from about 12 nt to about 50 nt, from about 12 nt to about 40 nt, from about 12 nt to about 30 nt, from about 12 nt to about 25 nt, from about 12 nt to about 20 nt, or from about 12 nt to about 19 nt. For example, the DNA-targeting segment can have a length of from about 19 nt to about 20 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 19 nt to about 70 nt, from about 19 nt to about 80 nt, from about 19 nt to about 90 nt, from about 19 nt to about 100 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, from about 20 nt to about 60 nt, from about 20 nt to about 70 nt, from about 20 nt to about 80 nt, from about 20 nt to about 90 nt, or from about 20 nt to about 100 nt.

The nucleotide sequence (the DNA-targeting sequence) of the DNA-targeting segment that is complementary to a nucleotide sequence (target sequence) of the target DNA can have a length at least about 12 nt. For example, the DNA-targeting sequence of the DNA-targeting segment that is complementary to a target sequence of the target DNA can have a length at least about 12 nt, at least about 15 nt, at least about 18 nt, at least about 19 nt, at least about 20 nt, at least about 25 nt, at least about 30 nt, at least about 35 nt or at least about 40 nt. For example, the DNA-targeting sequence of the DNA-targeting segment that is complementary to a target sequence of the target DNA can have a length of from about 12 nucleotides (nt) to about 80 nt, from about 12 nt to about 50 nt, from about 12 nt to about 45 nt, from about 12 nt to about 40 nt, from about 12 nt to about 35 nt, from about 12 nt to about 30 nt, from about 12 nt to about 25 nt, from about 12 nt to about 20 nt, from about 12 nt to about 19 nt, from about 19 nt to about 20 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. The nucleotide sequence (the DNA-targeting sequence) of the DNA-targeting segment that is complementary to a nucleotide sequence (target sequence) of the target DNA can have a length at least about 12 nt.

In some cases, the DNA-targeting sequence of the DNA-targeting segment that is complementary to a target sequence of the target DNA is 20 nucleotides in length. In some cases, the DNA-targeting sequence of the DNA-targeting segment that is complementary to a target sequence of the target DNA is 19 nucleotides in length.

The percent complementarity between the DNA-targeting sequence of the DNA-targeting segment and the target sequence of the target DNA can be at least 60% (e.g., at least 65%, at least 70%, at least 75%, at least 80%, at least 85%, at least 90%, at least 95%, at least 97%, at least 98%, at least 99%, or 100%). In some cases, the percent complementarity between the DNA-targeting sequence of the DNA-targeting segment and the target sequence of the target DNA is 100% over the seven contiguous 5'-most nucleotides of the target sequence of the complementary strand of the target DNA. In some cases, the percent complementarity between the DNA-targeting sequence of the DNA-targeting segment and the target sequence of the target DNA is at least 60% over about 20 contiguous nucleotides. In some cases, the percent complementarity between the DNA-targeting sequence of the DNA-targeting segment and the target sequence of the target DNA is 100% over the fourteen contiguous 5'-most nucleotides of the target sequence of the complementary strand of the target DNA and as low as 0% over the remainder. In such a case, the DNA-targeting sequence can be considered to be 14 nucleotides in length. In some cases, the percent complementarity between the DNA-targeting sequence of the DNA-targeting segment and the target sequence of the target DNA is 100% over the seven contiguous 5'-most nucleotides of the target sequence of the complementary strand of the target DNA and as low as 0% over the remainder. In such a case, the DNA-targeting sequence can be considered to be 7 nucleotides in length.

Protein-Binding Segment

The protein-binding segment (i.e., "protein-binding sequence") of a DNA-targeting RNA interacts with a variant site-directed polypeptide. When the variant Cas9 site-directed polypeptide, together with the DNA-targeting RNA, binds to a target DNA, transcription of the target DNA is reduced.

The protein-binding segment of a DNA-targeting RNA comprises two complementary stretches of nucleotides that hybridize to one another to form a double stranded RNA duplex (dsRNA duplex).

The protein-binding segment of a DNA-targeting RNA of the present disclosure comprises two stretches of nucleotides (a targeter-RNA and an activator-RNA) that are complementary to one another, are covalently linked by intervening nucleotides (e.g., in the case of a single-molecule DNA-targeting RNA)("linkers" or "linker nucleotides"), and hybridize to form the double stranded RNA duplex (dsRNA duplex, or "dCas9-binding hairpin") of the protein-binding segment, thus resulting in a stem-loop structure. This stem-loop structure is shown schematically in FIG. 39A. The targeter-RNA and the activator-RNA can be covalently linked via the 3' end of the targeter-RNA and the 5' end of the activator-RNA. Alternatively, targeter-RNA and the activator-RNA can be covalently linked via the 5' end of the targeter-RNA and the 3' end of the activator-RNA.

The protein-binding segment can have a length of from about 10 nucleotides to about 100 nucleotides, e.g., from about 10 nucleotides (nt) to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. For example, the protein-binding segment can have a length of from about 15 nucleotides (nt) to about 80 nt, from about 15 nt to about 50 nt, from about 15 nt to about 40 nt, from about 15 nt to about 30 nt or from about 15 nt to about 25 nt.

The dsRNA duplex of the protein-binding segment can have a length from about 6 base pairs (bp) to about 50 bp. For example, the dsRNA duplex of the protein-binding segment can have a length from about 6 bp to about 40 bp, from about 6 bp to about 30 bp, from about 6 bp to about 25 bp, from about 6 bp to about 20 bp, from about 6 bp to about 15 bp, from about 8 bp to about 40 bp, from about 8 bp to about 30 bp, from about 8 bp to about 25 bp, from about 8 bp to about 20 bp or from about 8 bp to about 15 bp. For example, the dsRNA duplex of the protein-binding segment can have a length from about from about 8 bp to about 10 bp, from about 10 bp to about 15 bp, from about 15 bp to about 18 bp, from about 18 bp to about 20 bp, from about 20 bp to about 25 bp, from about 25 bp to about 30 bp, from about 30 bp to about 35 bp, from about 35 bp to about 40 bp, or from about 40 bp to about 50 bp. In some embodiments, the dsRNA duplex of the protein-binding segment has a length of 36 base pairs. The percent complementarity between the nucleotide sequences that hybridize to form the dsRNA duplex of the protein-binding segment can be at least about 60%. For example, the percent complementarity between the nucleotide sequences that hybridize to form the dsRNA duplex of the protein-binding segment can be at least about 65%, at least about 70%, at least about 75%, at least about 80%, at least about 85%, at least about 90%, at least about 95%, at least about 98%, or at least about 99%. In some cases, the percent complementarity between the nucleotide sequences that hybridize to form the dsRNA duplex of the protein-binding segment is 100%.

The linker can have a length of from about 3 nucleotides to about 100 nucleotides. For example, the linker can have a length of from about 3 nucleotides (nt) to about 90 nt, from about 3 nucleotides (nt) to about 80 nt, from about 3 nucleotides (nt) to about 70 nt, from about 3 nucleotides (nt) to about 60 nt, from about 3 nucleotides (nt) to about 50 nt, from about 3 nucleotides (nt) to about 40 nt, from about 3 nucleotides (nt) to about 30 nt, from about 3 nucleotides (nt) to about 20 nt or from about 3 nucleotides (nt) to about 10 nt. For example, the linker can have a length of from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. In some embodiments, the linker of a DNA-targeting RNA is 4 nt.

Non-limiting examples of nucleotide sequences that can be included in a suitable protein-binding segment (i.e., dCas9 handle) are set forth in SEQ ID NOs:563-682 (For examples, see FIG. 8 and FIG. 9).

In some cases, a suitable protein-binding segment comprises a nucleotide sequence that differs by 1, 2, 3, 4, or 5 nucleotides from any one of the above-listed sequences.

Stability Control Sequence (e.g., Transcriptional Terminator Segment)

A stability control sequence influences the stability of an RNA (e.g., a DNA-targeting RNA, a targeter-RNA, an activator-RNA, etc.). One example of a suitable stability control sequence is a transcriptional terminator segment (i.e., a transcription termination sequence). A transcriptional terminator segment of a subject DNA-targeting RNA can have a total length of from about 10 nucleotides to about 100 nucleotides, e.g., from about 10 nucleotides (nt) to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. For example, the transcriptional terminator segment can have a length of from about 15 nucleotides (nt) to about 80 nt, from about 15 nt to about 50 nt, from about 15 nt to about 40 nt, from about 15 nt to about 30 nt or from about 15 nt to about 25 nt.

In some cases, the transcription termination sequence is one that is functional in a eukaryotic cell. In some cases, the transcription termination sequence is one that is functional in a prokaryotic cell.

Non-limiting examples of nucleotide sequences that can be included in a stability control sequence (e.g., transcriptional termination segment, or in any segment of the DNA-targeting RNA to provide for increased stability) include sequences set forth in SEQ ID NO:683-696 and, for example, 5'-UAAUCCCACAGCCGCCAGUUCCGCUG-GCGGCAUUUU-5' (SEQ ID NO: 1349) (a Rho-independent trp termination site).

Additional Sequences

In some embodiments, a DNA-targeting RNA comprises at least one additional segment at either the 5' or 3' end. For example, a suitable additional segment can comprise a 5' cap (e.g., a 7-methylguanylate cap ($m^7G$)); a 3' polyadenylated tail (i.e., a 3' poly(A) tail); a riboswitch sequence (e.g., to allow for regulated stability and/or regulated accessibility by proteins and protein complexes); a sequence that forms a dsRNA duplex (i.e., a hairpin)); a sequence that targets the RNA to a subcellular location (e.g., nucleus, mitochondria, chloroplasts, and the like); a modification or sequence that provides for tracking (e.g., direct conjugation to a fluorescent molecule, conjugation to a moiety that facilitates fluorescent detection, a sequence that allows for fluorescent detection, etc.); a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like) a modification or sequence that provides for increased, decreased, and/or controllable stability; and combinations thereof.

Multiple Simultaneous DNA-Targeting RNAs

In some embodiments, multiple DNA-targeting RNAs are used simultaneously in the same cell to simultaneously modulate transcription at different locations on the same target DNA or on different target DNAs. In some embodiments, two or more DNA-targeting RNAs target the same gene or transcript or locus. In some embodiments, two or more DNA-targeting RNAs target different unrelated loci. In some embodiments, two or more DNA-targeting RNAs target different, but related loci.

Because the DNA-targeting RNAs are small and robust they can be simultaneously present on the same expression vector and can even be under the same transcriptional control if so desired. In some embodiments, two or more (e.g., 3 or more, 4 or more, 5 or more, 10 or more, 15 or more, 20 or more, 25 or more, 30 or more, 35 or more, 40 or more, 45 or more, or 50 or more) DNA-targeting RNAs are simultaneously expressed in a target cell (from the same or different vectors). The expressed DNA-targeting RNAs can be differently recognized by dCas9 proteins from different bacteria, such as *S. pyogenes, S. thermophilus, L. innocua*, and *N. meningitidis*.

To express multiple DNA-targeting RNAs, an artificial RNA processing system mediated by the Csy4 endoribonuclease can be used. Multiple DNA-targeting RNAs can be concatenated into a tandem array on a precursor transcript (e.g., expressed from a U6 promoter), and separated by Csy4-specific RNA sequence. Co-expressed Csy4 protein cleaves the precursor transcript into multiple DNA-targeting RNAs. Advantages for using an RNA processing system include: first, there is no need to use multiple promoters; second, since all DNA-targeting RNAs are processed from a precursor transcript, their concentrations are normalized for similar dCas9-binding.

Csy4 is a small endoribonuclease (RNase) protein derived from bacteria *Pseudomonas aeruginosa*. Csy4 specifically recognizes a minimal 17-bp RNA hairpin, and exhibits rapid (<1 min) and highly efficient (>99.9%) RNA cleavage. Unlike most RNases, the cleaved RNA fragment remains stable and functionally active. The Csy4-based RNA cleavage can be repurposed into an artificial RNA processing system. In this system, the 17-bp RNA hairpins are inserted between multiple RNA fragments that are transcribed as a precursor transcript from a single promoter. Co-expression of Csy4 is effective in generating individual RNA fragments.

Site-Directed Polypeptide

As noted above, a subject DNA-targeting RNA and a variant Cas9 site-directed polypeptide form a complex. The DNA-targeting RNA provides target specificity to the complex by comprising a nucleotide sequence that is complementary to a sequence of a target DNA.

The variant Cas9 site-directed polypeptide has reduced endodeoxyribonuclease activity. For example, a variant Cas9 site-directed polypeptide suitable for use in a transcription modulation method of the present disclosure exhibits less than about 20%, less than about 15%, less than about 10%, less than about 5%, less than about 1%, or less than about 0.1%, of the endodeoxyribonuclease activity of a wild-type Cas9 polypeptide, e.g., a wild-type Cas9 polypeptide comprising an amino acid sequence as depicted in FIG. 3A and FIG. 3B (SEQ ID NO:8). In some embodiments, the variant Cas9 site-directed polypeptide has substantially no detectable endodeoxyribonuclease activity. In some embodiments when a site-directed polypeptide has reduced catalytic activity (e.g., when a Cas9 protein has a D10, G12, G17, E762, H840, N854, N863, H982, H983, A984, D986, and/or a A987 mutation, e.g., DI OA, G12A, G17A, E762A, H840A, N854A, N863A, H982A, H983A, A984A, and/or D986A), the polypeptide can still bind to target DNA in a site-specific manner (because it is still guided to a target DNA sequence by a DNA-targeting RNA) as long as it retains the ability to interact with the DNA-targeting RNA.

In some cases, a suitable variant Cas9 site-directed polypeptide comprises an amino acid sequence having at least about 75%, at least about 80%, at least about 85%, at least about 90%, at least about 95%, at least about 99% or 100% amino acid sequence identity to amino acids 7-166 or 731-1003 of the Cas9/Csn1 amino acid sequence depicted in FIG. 3A and FIG. 3B (SEQ ID NO:8), or to the corresponding portions in any one of the amino acid sequences SEQ ID NOs:1-256 and 795-1346.

In some cases, the variant Cas9 site-directed polypeptide can cleave the complementary strand of the target DNA but has reduced ability to cleave the non-complementary strand of the target DNA. For example, the variant Cas9 site-directed polypeptide can have a mutation (amino acid substitution) that reduces the function of the RuvC domain (e.g., "domain 1" of FIG. 3B). As a non-limiting example, in some cases, the variant Cas9 site-directed polypeptide is a D10A (aspartate to alanine) mutation of the amino acid sequence depicted in FIG. 3A and FIG. 3B (or the corresponding mutation of any of the amino acid sequences set forth in SEQ ID NOs:1-256 and 795-1346).

In some cases, the variant Cas9 site-directed polypeptide can cleave the non-complementary strand of the target DNA but has reduced ability to cleave the complementary strand of the target DNA. For example, the variant Cas9 site-directed polypeptide can have a mutation (amino acid substitution) that reduces the function of the HNH domain (RuvC/HNH/RuvC domain motifs, "domain 2" of FIG. 3B). As a non-limiting example, in some cases, the variant Cas9 site-directed polypeptide is a H840A (histidine to alanine at amino acid position 840 of SEQ ID NO:8) or the corresponding mutation of any of the amino acid sequences set forth in SEQ ID NOs:1-256 and 795-1346).

In some cases, the variant Cas9 site-directed polypeptide has a reduced ability to cleave both the complementary and the non-complementary strands of the target DNA. As a non-limiting example, in some cases, the variant Cas9 site-directed polypeptide harbors both D10A and H840A mutations of the amino acid sequence depicted in FIG. 3A and FIG. 3B (or the corresponding mutations of any of the amino acid sequences set forth in SEQ ID NOs:1-256 and 795-1346).

Other residues can be mutated to achieve the same effect (i.e. inactivate one or the other nuclease portions). As non-limiting examples, residues D10, G12, G17, E762, H840, N854, N863, H982, H983, A984, D986, and/or A987 (or the corresponding mutations of any of the proteins set forth as SEQ ID NOs:1-256 and 795-1346) can be altered (i.e., substituted) (see FIG. 3A-3B, FIG. 5, FIG. 11A, and Table 1 for more information regarding the conservation of Cas9 amino acid residues). Also, mutations other than alanine substitutions are suitable.

In some cases, the variant Cas9 site-directed polypeptide is a fusion polypeptide (a "variant Cas9 fusion polypeptide"), i.e., a fusion polypeptide comprising: i) a variant Cas9 site-directed polypeptide; and b) a covalently linked heterologous polypeptide (also referred to as a "fusion partner").

The heterologous polypeptide may exhibit an activity (e.g., enzymatic activity) that will also be exhibited by the variant Cas9 fusion polypeptide (e.g., methyltransferase activity, acetyltransferase activity, kinase activity, ubiquitinating activity, etc.). A heterologous nucleic acid sequence may be linked to another nucleic acid sequence (e.g., by genetic engineering) to generate a chimeric nucleotide sequence encoding a chimeric polypeptide. In some embodiments, a variant Cas9 fusion polypeptide is generated by fusing a variant Cas9 polypeptide with a heterologous sequence that provides for subcellular localization (i.e., the heterologous sequence is a subcellular localization sequence, e.g., a nuclear localization signal (NLS) for targeting to the nucleus; a mitochondrial localization signal for targeting to the mitochondria; a chloroplast localization signal for targeting to a chloroplast; an ER retention signal; and the like). In some embodiments, the heterologous sequence can provide a tag (i.e., the heterologous sequence is a detectable label) for ease of tracking and/or purification (e.g., a fluorescent protein, e.g., green fluorescent protein (GFP), YFP, RFP, CFP, mCherry, tdTomato, and the like; a histidine tag, e.g., a 6×His tag; a hemagglutinin (HA) tag; a FLAG tag; a Myc tag; and the like). In some embodiments, the heterologous sequence can provide for increased or decreased stability (i.e., the heterologous sequence is a stability control peptide, e.g., a degron, which in some cases is controllable (e.g., a temperature sensitive or drug controllable degron sequence, see below). In some embodiments, the heterologous sequence can provide for increased or decreased transcription from the target DNA (i.e., the heterologous sequence is a transcription modulation sequence, e.g., a transcription factor/activator or a fragment thereof, a protein or fragment thereof that recruits a transcription factor/activator, a transcription repressor or a fragment thereof, a protein or fragment thereof that recruits a transcription repressor, a small molecule/drug-responsive transcription regulator, etc.). In some embodiments, the heterologous sequence can provide a binding domain (i.e., the heterologous sequence is a protein binding sequence, e.g., to provide the ability of a chimeric dCas9 polypeptide to bind to another protein of interest, e.g., a DNA or histone modifying protein, a transcription factor or transcription repressor, a recruiting protein, etc.).

Suitable fusion partners that provide for increased or decreased stability include, but are not limited to degron sequences. Degrons are readily understood by one of ordinary skill in the art to be amino acid sequences that control the stability of the protein of which they are part. For example, the stability of a protein comprising a degron sequence is controlled at least in part by the degron sequence. In some cases, a suitable degron is constitutive such that the degron exerts its influence on protein stability independent of experimental control (i.e., the degron is not drug inducible, temperature inducible, etc.) In some cases, the degron provides the variant Cas9 polypeptide with controllable stability such that the variant Cas9 polypeptide can be turned "on" (i.e., stable) or "off" (i.e., unstable, degraded) depending on the desired conditions. For example, if the degron is a temperature sensitive degron, the variant Cas9 polypeptide may be functional (i.e., "on", stable) below a threshold temperature (e.g., 42° C., 41° C., 40° C., 39° C., 38° C., 37° C., 36° C., 35° C., 34° C., 33° C., 32° C., 31° C., 30° C., etc.) but non-functional (i.e., "off", degraded) above the threshold temperature. As another example, if the degron is a drug inducible degron, the presence or absence of drug can switch the protein from an "off" (i.e., unstable) state to an "on" (i.e., stable) state or vice versa. An exemplary drug inducible degron is derived from the FKBP12 protein. The stability of the degron is controlled by the presence or absence of a small molecule that binds to the degron.

Examples of suitable degrons include, but are not limited to those degrons controlled by Shield-1, DHFR, auxins, and/or temperature. Non-limiting examples of suitable degrons are known in the art (e.g., Dohmen et al., Science, 1994. 263(5151): p. 1273-1276: Heat-inducible degron: a method for constructing temperature-sensitive mutants; Schoeber et al., Am J Physiol Renal Physiol. 2009 January; 296(1):F204-11: Conditional fast expression and function of multimeric TRPV5 channels using Shield-1; Chu et al., Bioorg Med Chem Lett. 2008 Nov. 15; 18(22):5941-4: Recent progress with FKBP-derived destabilizing domains; Kanemaki, Pflugers Arch. 2012 Dec. 28: Frontiers of protein expression control with conditional degrons; Yang et al., Mol Cell. 2012 Nov. 30; 48(4):487-8: Titivated for destruction: the methyl degron; Barbour et al., Biosci Rep. 2013 Jan. 18; 33(1).: Characterization of the bipartite degron that regulates ubiquitin-independent degradation of thymidylate synthase; and Greussing et al., J Vis Exp. 2012 Nov. 10; (69): Monitoring of ubiquitin-proteasome activity in living cells using a Degron (dgn)-destabilized green fluorescent protein (GFP)-based reporter protein; all of which are hereby incorporated in their entirety by reference).

Exemplary degron sequences have been well-characterized and tested in both cells and animals. Thus, fusing dCas9 to a degron sequence produces a "tunable" and "inducible" dCas9 polypeptide. Any of the fusion partners described herein can be used in any desirable combination. As one non-limiting example to illustrate this point, a dCas9 fusion protein can comprise a YFP sequence for detection, a degron sequence for stability, and transcription activator sequence to increase transcription of the target DNA. Furthermore, the number of fusion partners that can be used in a dCas9 fusion protein is unlimited. In some cases, a dCas9 fusion protein comprises one or more (e.g. two or more, three or more, four or more, or five or more) heterologous sequences.

Suitable fusion partners include, but are not limited to, a polypeptide that provides for methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, or demyristoylation activity, any of which can be directed at modifying the DNA directly (e.g., methylation of DNA) or at modifying a DNA-associated polypeptide (e.g., a histone or DNA binding protein). Further suitable fusion partners include, but are not limited to boundary elements (e.g., CTCF), proteins and fragments thereof that provide periphery recruitment (e.g., Lamin A, Lamin B, etc.), and protein docking elements (e.g., FKBP/FRB, Pil1/Aby1, etc.).

Examples of various additional suitable fusion partners (or fragments thereof) for a subject variant Cas9 site-directed polypeptide include, but are not limited to those listed in FIG. 54A-54C.

In some embodiments, a subject site-directed modifying polypeptide can be codon-optimized. This type of optimization is known in the art and entails the mutation of foreign-derived DNA to mimic the codon preferences of the intended host organism or cell while encoding the same protein. Thus, the codons are changed, but the encoded protein remains unchanged. For example, if the intended target cell was a human cell, a human codon-optimized dCas9 (or dCas9 variant) would be a suitable site-directed modifying polypeptide. As another non-limiting example, if the intended host cell were a mouse cell, than a mouse codon-optimized Cas9 (or variant, e.g., enzymatically inactive variant) would be a suitable Cas9 site-directed polypeptide. While codon optimization is not required, it is acceptable and may be preferable in certain cases.

Host Cells

A method of the present disclosure to modulate transcription may be employed to induce transcriptional modulation in mitotic or post-mitotic cells in vivo and/or ex vivo and/or in vitro. Because the DNA-targeting RNA provides specificity by hybridizing to target DNA, a mitotic and/or post-mitotic cell can be any of a variety of host cell, where suitable host cells include, but are not limited to, a bacterial cell; an archaeal cell; a single-celled eukaryotic organism; a plant cell; an algal cell, e.g., *Botryococcus braunii, Chlamydomonas reinhardtii, Nannochloropsis gaditana, Chlorella pyrenoidosa, Sargassum patens, C. agardh*, and the like; a fungal cell; an animal cell; a cell from an invertebrate animal (e.g., an insect, a cnidarian, an echinoderm, a nematode, etc.); a eukaryotic parasite (e.g., a malarial parasite, e.g., *Plasmodium falciparum*; a helminth; etc.); a cell from a vertebrate animal (e.g., fish, amphibian, reptile, bird, mammal); a mammalian cell, e.g., a rodent cell, a human cell, a non-human primate cell, etc. Suitable host cells include naturally-occurring cells; genetically modified cells (e.g., cells genetically modified in a laboratory, e.g., by the "hand of man"); and cells manipulated in vitro in any way. In some cases, a host cell is isolated.

Any type of cell may be of interest (e.g. a stem cell, e.g. an embryonic stem (ES) cell, an induced pluripotent stem (iPS) cell, a germ cell; a somatic cell, e.g. a fibroblast, a hematopoietic cell, a neuron, a muscle cell, a bone cell, a hepatocyte, a pancreatic cell; an in vitro or in vivo embryonic cell of an embryo at any stage, e.g., a 1-cell, 2-cell, 4-cell, 8-cell, etc. stage zebrafish embryo; etc.). Cells may be from established cell lines or they may be primary cells, where "primary cells", "primary cell lines", and "primary cultures" are used interchangeably herein to refer to cells and cells cultures that have been derived from a subject and allowed to grow in vitro for a limited number of passages, i.e. splittings, of the culture. For example, primary cultures include cultures that may have been passaged 0 times, 1 time, 2 times, 4 times, 5 times, 10 times, or 15 times, but not enough times go through the crisis stage. Primary cell lines can be are maintained for fewer than 10 passages in vitro. Target cells are in many embodiments unicellular organisms, or are grown in culture.

If the cells are primary cells, such cells may be harvest from an individual by any convenient method. For example, leukocytes may be conveniently harvested by apheresis, leukocytapheresis, density gradient separation, etc., while cells from tissues such as skin, muscle, bone marrow, spleen, liver, pancreas, lung, intestine, stomach, etc. are most conveniently harvested by biopsy. An appropriate solution may be used for dispersion or suspension of the harvested cells. Such solution will generally be a balanced salt solution, e.g. normal saline, phosphate-buffered saline (PBS), Hank's balanced salt solution, etc., conveniently supplemented with fetal calf serum or other naturally occurring factors, in conjunction with an acceptable buffer at low concentration, e.g., from 5-25 mM. Convenient buffers include HEPES, phosphate buffers, lactate buffers, etc. The cells may be used immediately, or they may be stored, frozen, for long periods of time, being thawed and capable of being reused. In such cases, the cells will usually be frozen in 10% dimethyl sulfoxide (DMSO), 50% serum, 40% buffered medium, or some other such solution as is commonly used in the art to preserve cells at such freezing temperatures, and thawed in a manner as commonly known in the art for thawing frozen cultured cells.

Introducing Nucleic Acid into a Host Cell

A DNA-targeting RNA, or a nucleic acid comprising a nucleotide sequence encoding same, can be introduced into a host cell by any of a variety of well-known methods. Similarly, where a subject method involves introducing into a host cell a nucleic acid comprising a nucleotide sequence encoding a variant Cas9 site-directed polypeptide, such a nucleic acid can be introduced into a host cell by any of a variety of well-known methods.

Methods of introducing a nucleic acid into a host cell are known in the art, and any known method can be used to introduce a nucleic acid (e.g., an expression construct) into a stem cell or progenitor cell. Suitable methods include, include e.g., viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et., al Adv Drug Deliv Rev. 2012 Sep. 13. pii: 50169-409X(12)00283-9. doi: 10.1016/j.addr.2012.09.023), and the like.

Nucleic Acids

The present disclosure provides an isolated nucleic acid comprising a nucleotide sequence encoding a subject DNA-targeting RNA. In some cases, a subject nucleic acid also comprises a nucleotide sequence encoding a variant Cas9 site-directed polypeptide.

In some embodiments, a subject method involves introducing into a host cell (or a population of host cells) one or more nucleic acids comprising nucleotide sequences encoding a DNA-targeting RNA and/or a variant Cas9 site-directed polypeptide. In some embodiments a cell comprising a target DNA is in vitro. In some embodiments a cell comprising a target DNA is in vivo. Suitable nucleic acids comprising nucleotide sequences encoding a DNA-targeting RNA and/or a site-directed polypeptide include expression vectors, where an expression vector comprising a nucleotide sequence encoding a DNA-targeting RNA and/or a site-directed polypeptide is a "recombinant expression vector."

In some embodiments, the recombinant expression vector is a viral construct, e.g., a recombinant adeno-associated virus construct (see, e.g., U.S. Pat. No. 7,078,387), a recombinant adenoviral construct, a recombinant lentiviral construct, a recombinant retroviral construct, etc.

Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like.

Numerous suitable expression vectors are known to those of skill in the art, and many are commercially available. The following vectors are provided by way of example; for eukaryotic host cells: pXT1, pSG5 (Stratagene), pSVK3, pBPV, pMSG, and pSVLSV40 (Pharmacia). However, any other vector may be used so long as it is compatible with the host cell.

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology*, 153:516-544).

In some embodiments, a nucleotide sequence encoding a DNA-targeting RNA and/or a variant Cas9 site-directed polypeptide is operably linked to a control element, e.g., a transcriptional control element, such as a promoter. The transcriptional control element may be functional in either a eukaryotic cell, e.g., a mammalian cell; or a prokaryotic cell (e.g., bacterial or archaeal cell). In some embodiments, a nucleotide sequence encoding a DNA-targeting RNA and/or a variant Cas9 site-directed polypeptide is operably linked to multiple control elements that allow expression of the nucleotide sequence encoding a DNA-targeting RNA and/or a variant Cas9 site-directed polypeptide in both prokaryotic and eukaryotic cells.

A promoter can be a constitutively active promoter (i.e., a promoter that is constitutively in an active/"ON" state), it may be an inducible promoter (i.e., a promoter whose state, active/"ON" or inactive/"OFF", is controlled by an external stimulus, e.g., the presence of a particular temperature, compound, or protein.), it may be a spatially restricted promoter (i.e., transcriptional control element, enhancer, etc.)(e.g., tissue specific promoter, cell type specific promoter, etc.), and it may be a temporally restricted promoter (i.e., the promoter is in the "ON" state or "OFF" state during specific stages of embryonic development or during specific stages of a biological process, e.g., hair follicle cycle in mice).

Suitable promoters can be derived from viruses and can therefore be referred to as viral promoters, or they can be derived from any organism, including prokaryotic or eukaryotic organisms. Suitable promoters can be used to drive expression by any RNA polymerase (e.g., pol I, pol II, pol III). Exemplary promoters include, but are not limited to the SV40 early promoter, mouse mammary tumor virus long terminal repeat (LTR) promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, a human U6 small nuclear promoter (U6) (Miyagishi et al., Nature Biotechnology 20, 497-500 (2002)), an enhanced U6 promoter (e.g., Xia et al., Nucleic Acids Res. 2003 Sep. 1; 31(17)), a human H1 promoter (H1), and the like.

Examples of inducible promoters include, but are not limited to T7 RNA polymerase promoter, T3 RNA polymerase promoter, Isopropyl-beta-D-thiogalactopyranoside (IPTG)-regulated promoter, lactose induced promoter, heat shock promoter, Tetracycline-regulated promoter (e.g., Tet-ON, Tet-OFF, etc.), Steroid-regulated promoter, Metal-regulated promoter, estrogen receptor-regulated promoter, etc. Inducible promoters can therefore be regulated by molecules including, but not limited to, doxycycline; RNA polymerase, e.g., T7 RNA polymerase; an estrogen receptor; an estrogen receptor fusion; etc.

In some embodiments, the promoter is a spatially restricted promoter (i.e., cell type specific promoter, tissue specific promoter, etc.) such that in a multi-cellular organism, the promoter is active (i.e., "ON") in a subset of specific cells. Spatially restricted promoters may also be referred to as enhancers, transcriptional control elements, control sequences, etc. Any convenient spatially restricted promoter may be used and the choice of suitable promoter (e.g., a brain specific promoter, a promoter that drives expression in a subset of neurons, a promoter that drives expression in the germline, a promoter that drives expression in the lungs, a promoter that drives expression in muscles, a promoter that drives expression in islet cells of the pancreas, etc.) will depend on the organism. For example, various spatially restricted promoters are known for plants, flies, worms, mammals, mice, etc. Thus, a spatially restricted promoter can be used to regulate the expression of a nucleic acid encoding a subject site-directed polypeptide in a wide variety of different tissues and cell types, depending on the organism. Some spatially restricted promoters are also temporally restricted such that the promoter is in the "ON" state or "OFF" state during specific stages of embryonic development or during specific stages of a biological process (e.g., hair follicle cycle in mice).

For illustration purposes, examples of spatially restricted promoters include, but are not limited to, neuron-specific promoters, adipocyte-specific promoters, cardiomyocyte-specific promoters, smooth muscle-specific promoters, photoreceptor-specific promoters, etc. Neuron-specific spatially restricted promoters include, but are not limited to, a neuron-specific enolase (NSE) promoter (see, e.g., EMBL HSENO2, X51956); an aromatic amino acid decarboxylase (AADC) promoter; a neurofilament promoter (see, e.g., GenBank HUMNFL, L04147); a synapsin promoter (see, e.g., GenBank HUMSYNIB, M55301); a thy-1 promoter (see, e.g., Chen et al. (1987) *Cell* 51:7-19; and Llewellyn, et al. (2010) *Nat. Med.* 16(10):1161-1166); a serotonin receptor promoter (see, e.g., GenBank S62283); a tyrosine hydroxylase promoter (TH) (see, e.g., Oh et al. (2009) *Gene Ther* 16:437; Sasaoka et al. (1992) *Mol. Brain Res.* 16:274; Boundy et al. (1998) *J. Neurosci.* 18:9989; and Kaneda et al. (1991) *Neuron* 6:583-594); a GnRH promoter (see, e.g., Radovick et al. (1991) *Proc. Natl. Acad. Sci. USA* 88:3402-3406); an L7 promoter (see, e.g., Oberdick et al. (1990) *Science* 248:223-226); a DNMT promoter (see, e.g., Bartge et al. (1988) *Proc. Natl. Acad. Sci. USA* 85:3648-3652); an enkephalin promoter (see, e.g., Comb et al. (1988) *EMBO J.* 17:3793-3805); a myelin basic protein (MBP) promoter; a $Ca^{2+}$-calmodulin-dependent protein kinase II-alpha (CamKIIα) promoter (see, e.g., Mayford et al. (1996) *Proc. Natl. Acad. Sci. USA* 93:13250; and Casanova et al. (2001) *Genesis* 31:37); a CMV enhancer/platelet-derived growth factor-β promoter (see, e.g., Liu et al. (2004) *Gene Therapy* 11:52-60); and the like.

Adipocyte-specific spatially restricted promoters include, but are not limited to aP2 gene promoter/enhancer, e.g., a region from −5.4 kb to +21 bp of a human aP2 gene (see, e.g., Tozzo et al. (1997) *Endocrinol.* 138:1604; Ross et al. (1990) *Proc. Natl. Acad. Sci. USA* 87:9590; and Pavjani et al. (2005) *Nat. Med.* 11:797); a glucose transporter-4 (GLUT4) promoter (see, e.g., Knight et al. (2003) *Proc. Natl. Acad. Sci. USA* 100:14725); a fatty acid translocase (FAT/CD36) promoter (see, e.g., Kuriki et al. (2002) *Biol. Pharm. Bull.* 25:1476; and Sato et al. (2002) *J. Biol. Chem.* 277:15703); a stearoyl-CoA desaturase-1 (SCD1) promoter (Tabor et al. (1999) *J. Biol. Chem.* 274:20603); a leptin promoter (see, e.g., Mason et al. (1998) *Endocrinol.* 139: 1013; and Chen et al. (1999) *Biochem. Biophys. Res. Comm.* 262:187); an adiponectin promoter (see, e.g., Kita et al. (2005) *Biochem. Biophys. Res. Comm.* 331:484; and Chakrabarti (2010) *Endocrinol.* 151:2408); an adipsin promoter (see, e.g., Platt et al. (1989) *Proc. Natl. Acad. Sci. USA* 86:7490); a resistin promoter (see, e.g., Seo et al. (2003) *Molec. Endocrinol.* 17:1522); and the like.

Cardiomyocyte-specific spatially restricted promoters include, but are not limited to control sequences derived from the following genes: myosin light chain-2, α-myosin heavy chain, AE3, cardiac troponin C, cardiac actin, and the like. Franz et al. (1997) Cardiovasc. Res. 35:560-566; Robbins et al. (1995) Ann. N.Y. Acad. Sci. 752:492-505; Linn et al. (1995) Circ. Res. 76:584-591; Parmacek et al. (1994) Mol. Cell. Biol. 14:1870-1885; Hunter et al. (1993) Hypertension 22:608-617; and Sartorelli et al. (1992) Proc. Natl. Acad. Sci. USA 89:4047-4051.

Smooth muscle-specific spatially restricted promoters include, but are not limited to an SM22α promoter (see, e.g., Akyürek et al. (2000) *Mol. Med.* 6:983; and U.S. Pat. No. 7,169,874); a smoothelin promoter (see, e.g., WO 2001/018048); an α-smooth muscle actin promoter; and the like. For example, a 0.4 kb region of the SM22α promoter, within which lie two CArG elements, has been shown to mediate vascular smooth muscle cell-specific expression (see, e.g., Kim, et al. (1997) Mol. Cell. Biol. 17, 2266-2278; Li, et al., (1996) J. Cell Biol. 132, 849-859; and Moessler, et al. (1996) Development 122, 2415-2425).

Photoreceptor-specific spatially restricted promoters include, but are not limited to, a rhodopsin promoter; a rhodopsin kinase promoter (Young et al. (2003) *Ophthalmol. Vis. Sci.* 44:4076); a beta phosphodiesterase gene promoter (Nicoud et al. (2007) *J. Gene Med.* 9:1015); a retinitis pigmentosa gene promoter (Nicoud et al. (2007) supra); an interphotoreceptor retinoid-binding protein (IRBP) gene enhancer (Nicoud et al. (2007) supra); an IRBP gene promoter (Yokoyama et al. (1992) *Exp Eye Res.* 55:225); and the like.

Libraries

The present disclosure provides a library of DNA-targeting RNAs. The present disclosure provides a library of nucleic acids comprising nucleotides encoding DNA-targeting RNAs. A subject library of nucleic acids comprising nucleotides encoding DNA-targeting RNAs can comprises a library of recombinant expression vectors comprising nucleotides encoding the DNA-targeting RNAs.

A subject library can comprise from about 10 individual members to about $10^{12}$ individual members; e.g., a subject library can comprise from about 10 individual members to about $10^2$ individual members, from about $10^2$ individual members to about $10^3$ individual members, from about $10^3$ individual members to about $10^5$ individual members, from about $10^5$ individual members to about $10^7$ individual members, from about $10^7$ individual members to about $10^9$ individual members, or from about $10^9$ individual members to about $10^{12}$ individual members.

An "individual member" of a subject library differs from other members of the library in the nucleotide sequence of the DNA targeting segment of the DNA-targeting RNA. Thus, e.g., each individual member of a subject library can comprise the same or substantially the same nucleotide sequence of the protein-binding segment as all other members of the library; and can comprise the same or substantially the same nucleotide sequence of the transcriptional termination segment as all other members of the library; but differs from other members of the library in the nucleotide sequence of the DNA targeting segment of the DNA-targeting RNA. In this way, the library can comprise members that bind to different target nucleic acids.

Utility

A method for modulating transcription according to the present disclosure finds use in a variety of applications, which are also provided. Applications include research applications; diagnostic applications; industrial applications; and treatment applications.

Research applications include, e.g., determining the effect of reducing or increasing transcription of a target nucleic acid on, e.g., development, metabolism, expression of a downstream gene, and the like.

High through-put genomic analysis can be carried out using a subject transcription modulation method, in which only the DNA-targeting segment of the DNA-targeting RNA needs to be varied, while the protein-binding segment and the transcription termination segment can (in some cases) be held constant. A library (e.g., a subject library) comprising a plurality of nucleic acids used in the genomic analysis would include: a promoter operably linked to a DNA-targeting RNA-encoding nucleotide sequence, where each nucleic acid would include a different DNA-targeting segment, a common protein-binding segment, and a common transcription termination segment. A chip could contain over $5 \times 10^4$ unique DNA-targeting RNAs. Applications would include large-scale phenotyping, gene-to-function mapping, and meta-genomic analysis.

The subject methods disclosed herein find use in the field of metabolic engineering. Because transcription levels can be efficiently and predictably controlled by designing an appropriate DNA-targeting RNA, as disclosed herein, the activity of metabolic pathways (e.g., biosynthetic pathways) can be precisely controlled and tuned by controlling the level of specific enzymes (e.g., via increased or decreased transcription) within a metabolic pathway of interest. Metabolic pathways of interest include those used for chemical (fine chemicals, fuel, antibiotics, toxins, agonists, antagonists, etc.) and/or drug production.

Biosynthetic pathways of interest include but are not limited to (1) the mevalonate pathway (e.g., HMG-CoA reductase pathway) (converts acetyl-CoA to dimethylallyl pyrophosphate (DMAPP) and isopentenyl pyrophosphate (IPP), which are used for the biosynthesis of a wide variety of biomolecules including terpenoids/isoprenoids), (2) the non-mevalonate pathway (i.e., the "2-C-methyl-D-erythritol 4-phosphate/1-deoxy-D-xylulose 5-phosphate pathway" or "MEP/DOXP pathway" or "DXP pathway")(also produces DMAPP and IPP, instead by converting pyruvate and glyceraldehyde 3-phosphate into DMAPP and IPP via an alternative pathway to the mevalonate pathway), (3) the polyketide synthesis pathway (produces a variety of polyketides via a variety of polyketide synthase enzymes. Polyketides include naturally occurring small molecules used for chemotherapy (e. g., tetracyclin, and macrolides) and industrially important polyketides include rapamycin (immunosuppressant), erythromycin (antibiotic), lovastatin (anticholesterol drug), and epothilone B (anticancer drug)), (4) fatty acid synthesis pathways, (5) the DAHP (3-deoxy-D-arabino-heptulosonate 7-phosphate) synthesis pathway, (6) pathways that produce potential biofuels (such as short-chain alcohols and alkane, fatty acid methyl esters and fatty alcohols, isoprenoids, etc.), etc.

Networks and Cascades

The methods disclosed herein can be used to design integrated networks (i.e., a cascade or cascades) of control. For example, a subject DNA-targeting RNA/variant Cas9 site-directed polypeptide may be used to control (i.e., modulate, e.g., increase, decrease) the expression of another DNA-targeting RNA or another subject variant Cas9 site-directed polypeptide. For example, a first DNA-targeting RNA may be designed to target the modulation of transcription of a second chimeric dCas9 polypeptide with a function that is different than the first variant Cas9 site-directed polypeptide (e.g., methyltransferase activity, demethylase activity, acetyltansferase activity, deacetylase activity, etc.). In addition, because different dCas9 proteins (e.g., derived from different species) may require a different Cas9 handle (i.e., protein binding segment), the second chimeric dCas9 polypeptide can be derived from a different species than the first dCas9 polypeptide above. Thus, in some cases, the second chimeric dCas9 polypeptide can be selected such that it may not interact with the first DNA-targeting RNA. In other cases, the second chimeric dCas9 polypeptide can be selected such that it does interact with the first DNA-targeting RNA. In some such cases, the activities of the two (or more) dCas9 proteins may compete (e.g., if the polypeptides have opposing activities) or may synergize (e.g., if the polypeptides have similar or synergistic activities). Likewise, as noted above, any of the complexes (i.e., DNA-targeting RNA/dCas9 polypeptide) in the network can be designed to control other DNA-targeting RNAs or dCas9 polypeptides. Because a subject DNA-targeting RNA and subject variant Cas9 site-directed polypeptide can be targeted to any desired DNA sequence, the methods described herein can be used to control and regulate the expression of any desired target. The integrated networks (i.e., cascades of interactions) that can be designed range from very simple to very complex, and are without limit.

In a network wherein two or more components (e.g., DNA-targeting RNAs, activator-RNAs, targeter-RNAs, or dCas9 polypeptides) are each under regulatory control of another DNA-targeting RNA/dCas9 polypeptide complex, the level of expression of one component of the network may affect the level of expression (e.g., may increase or decrease the expression) of another component of the network. Through this mechanism, the expression of one component may affect the expression of a different component in the same network, and the network may include a mix of components that increase the expression of other components, as well as components that decrease the expression of other components. As would be readily understood by one of skill in the art, the above examples whereby the level of expression of one component may affect the level of expression of one or more different component(s) are for illustrative purposes, and are not limiting. An additional layer of complexity may be optionally introduced into a network when one or more components are modified (as described above) to be manipulable (i.e., under experimental control, e.g., temperature control; drug control, i.e., drug inducible control; light control; etc.).

As one non-limiting example, a first DNA-targeting RNA can bind to the promoter of a second DNA-targeting RNA, which controls the expression of a target therapeutic/metabolic gene. In such a case, conditional expression of the first DNA-targeting RNA indirectly activates the therapeutic/metabolic gene. RNA cascades of this type are useful, for example, for easily converting a repressor into an activator, and can be used to control the logics or dynamics of expression of a target gene.

A subject transcription modulation method can also be used for drug discovery and target validation.

Kits

The present disclosure provides a kit for carrying out a subject method. A subject kit comprises: a) a DNA-targeting RNA of the present disclosure, or a nucleic acid comprising a nucleotide sequence encoding the DNA-targeting RNA, wherein the DNA-targeting RNA comprises: i)) a first segment comprising a nucleotide sequence that is complementary to a target sequence in the target DNA; ii)) a second segment that interacts with a site-directed polypeptide; and iii) a transcriptional terminator; and b) a buffer. In some cases, the nucleic acid comprising a nucleotide sequence encoding the DNA-targeting RNA further comprises a nucleotide sequence encoding a variant Cas9 site-directed polypeptide that exhibits reduced endodeoxyribonuclease activity relative to wild-type Cas9.

In some cases, a subject kit further comprises a variant Cas9 site-directed polypeptide that exhibits reduced endodeoxyribonuclease activity relative to wild-type Cas9.

In some cases, a subject kit further comprises a nucleic acid comprising a nucleotide sequence encoding a variant Cas9 site-directed polypeptide that exhibits reduced endodeoxyribonuclease activity relative to wild-type Cas9.

A subject can further include one or more additional reagents, where such additional reagents can be selected from: a buffer; a wash buffer; a control reagent; a control expression vector or RNA polynucleotide; a reagent for in vitro production of the variant Cas9 site-directed polypeptide from DNA; and the like. In some cases, the variant Cas9 site-directed polypeptide included in a subject kit is a fusion variant Cas9 site-directed polypeptide, as described above.

Components of a subject kit can be in separate containers; or can be combined in a single container.

In addition to above-mentioned components, a subject kit can further include instructions for using the components of the kit to practice the subject methods. The instructions for practicing the subject methods are generally recorded on a suitable recording medium. For example, the instructions may be printed on a substrate, such as paper or plastic, etc.

As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, flash drive, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal(ly); s.c., subcutaneous(ly); and the like.

Example 1: Use of Cas9 to Generate Modifications in Target DNA

Materials and Methods
Bacterial Strains and Culture Conditions
*Streptococcus pyogenes*, cultured in THY medium (Todd Hewitt Broth (THB, Bacto, Becton Dickinson) supplemented with 0.2% yeast extract (Oxoid)) or on TSA (trypticase soy agar, BBL, Becton Dickinson) supplemented with 3% sheep blood, was incubated at 37° C. in an atmosphere supplemented with 5% $CO_2$ without shaking. *Escherichia coli*, cultured in Luria-Bertani (LB) medium and agar, was incubated at 37° C. with shaking. When required, suitable antibiotics were added to the medium at the following final concentrations: ampicillin, 100 µg/ml for *E. coli*; chloramphenicol, 33 µg/ml for *Escherichia coli*; kanamycin, 25 µg/ml for *E. coli* and 300 µg/ml for *S. pyogenes*. Bacterial cell growth was monitored periodically by measuring the optical density of culture aliquots at 620 nm using a microplate reader (SLT Spectra Reader).
Transformation of Bacterial Cells
Plasmid DNA transformation into *E. coli* cells was performed according to a standard heat shock protocol. Transformation of *S. pyogenes* was performed as previously described with some modifications. The transformation assay performed to monitor in vivo CRISPR/Cas activity on plasmid maintenance was essentially carried out as described previously. Briefly, electrocompetent cells of *S. pyogenes* were equalized to the same cell density and electroporated with 500 ng of plasmid DNA. Every transformation was plated two to three times and the experiment was performed three times independently with different batches of competent cells for statistical analysis. Transformation efficiencies were calculated as CFU (colony forming units) per µg of DNA. Control transformations were performed with sterile water and backbone vector pEC85.
DNA Manipulations
DNA manipulations including DNA preparation, amplification, digestion, ligation, purification, agarose gel electrophoresis were performed according to standard techniques with minor modifications. Protospacer plasmids for the in vitro cleavage and *S. pyogenes* transformation assays were constructed as described previously (4). Additional pUC19-based protospacer plasmids for in vitro cleavage assays were generated by ligating annealed oligonucleotides between digested EcoRI and BamHI sites in pUC19. The GFP gene-containing plasmid has been described previously (41). Kits (Qiagen) were used for DNA purification and plasmid preparation. Plasmid mutagenesis was performed using QuikChange® II XL kit (Stratagene) or QuikChange site-directed mutagenesis kit (Agilent). VBC-Biotech Services, Sigma-Aldrich and Integrated DNA Technologies supplied the synthetic oligonucleotides and RNAs.
Oligonucleotides for In Vitro Transcription Templates
Templates for In Vitro Transcribed CRISPR Type II-A tracrRNA and crRNAs of *S. pyogenes* (for tracrRNA—PCR on Chr. DNA SF370; for crRNA—Annealing of Two Oligonucleotides)
T7-tracrRNA (75 nt)
OLEC1521 (F 5' tracrRNA): SEQ ID NO:340
OLEC1522 (R 3' tracrRNA): SEQ ID NO:341
T7-crRNA (template)
OLEC2176 (F crRNA-sp1): SEQ ID NO:342
OLEC2178 (R crRNA-sp1): SEQ ID NO:343
OLEC2177 (F crRNA-sp2): SEQ ID NO:344
OLEC2179 (R crRNA-sp2): SEQ ID NO:345
Templates for In Vitro Transcribed *N. meningitidis* tracrRNA and Engineered crRNA-Sp2 (for tracrRNA—PCR on Chr. DNA Z2491; for crRNA—Annealing of Two Oligonucleotides)
T7-tracrRNA
OLEC2205 (F predicted 5'): SEQ ID NO:346
OLEC2206 (R predicted 3'): SEQ ID NO:347
T7-crRNA (Template)
OLEC2209 (F sp2(speM)+N.m. repeat): SEQ ID NO:348
OLEC2214 (R sp2(speM)+N.m. repeat): SEQ ID NO:349
Templates for In Vitro Transcribed *L. innocua* tracrRNA and Engineered crRNA-Sp2 (for tracrRNA—PCR on Chr. DNA Clip11262; for crRNA—Annealing of Two Oligonucleotides)
T7-tracrRNA
OLEC2203 (F predicted 5'): SEQ ID NO:350
OLEC2204 (R predicted 3'): SEQ ID NO:351
T7-crRNA (template)
OLEC2207 (F sp2(speM)+L.in. repeat): SEQ ID NO:352
OLEC2212 (R sp2(speM)+L.in. repeat): SEQ ID NO:353
Oligonucleotides for Constructing Plasmids with Protospacer for In Vitro and In Vivo Studies
Plasmids for speM (Spacer 2 (CRISPR Type II-A, SF370; Protospacer Prophage ø8232.3 from MGAS8232) Analysis In Vitro and in *S. pyogenes* (Template: Chr. DNA MGAS8232 or Plasmids Containing speM Fragments)
pEC287
OLEC1555 (F speM): SEQ ID NO:354
OLEC1556 (R speM): SEQ ID NO:355
pEC488
OLEC2145 (F speM): SEQ ID NO:356
OLEC2146 (R speM): SEQ ID NO:357 pEC370
OLEC1593 (F pEC488 protospacer 2 A22G): SEQ ID NO:358
OLEC1594 (R pEC488 protospacer 2 A22G): SEQ ID NO:359
pEC371
OLEC1595 (F pEC488 protospacer 2 T10C): SEQ ID NO:360
OLEC1596 (R pEC488 protospacer 2 T10C): SEQ ID NO:361
pEC372
OLEC2185 (F pEC488 protospacer 2 T7A): SEQ ID NO:362
OLEC2186 (R pEC488 protospacer 2 T7A): SEQ ID NO:363
pEC373
OLEC2187 (F pEC488 protospacer 2 A6T): SEQ ID NO:364
OLEC2188 (R pEC488 protospacer 2 A6T): SEQ ID NO:365
pEC374
OLEC2235 (F pEC488 protospacer 2 A5T): SEQ ID NO:366
OLEC2236 (R pEC488 protospacer 2 A5T): SEQ ID NO:367
pEC375
OLEC2233 (F pEC488 protospacer 2 A4T): SEQ ID NO:368
OLEC2234 (R pEC488 protospacer 2 A4T): SEQ ID NO:369
pEC376
OLEC2189 (F pEC488 protospacer 2 A3T): SEQ ID NO:370
OLEC2190 (R pEC488 protospacer 2 A3T): SEQ ID NO:371
pEC377
OLEC2191 (F pEC488 protospacer 2 PAM G1C): SEQ ID NO:372
OLEC2192 (R pEC488 protospacer 2 PAM G1C): SEQ ID NO:373
pEC378
OLEC2237 (F pEC488 protospacer 2 PAM GG1, 2CC): SEQ ID NO:374
OLEC2238 (R pEC488 protospacer 2 PAM GG1, 2CC): SEQ ID NO:375
Plasmids for SPy_0700 (Spacer 1 (CRISPR Type II-A, SF370; Protospacer Prophage ø370.1 from SF370) Analysis In Vitro and in *S. pyogenes* (Template: Chr. DNA SF370 or Plasmids Containing SPy_0700 Fragments)
pEC489
OLEC2106 (F Spy_0700): SEQ ID NO:376
OLEC2107 (R Spy_0700): SEQ ID NO:377
pEC573
OLEC2941 (F PAM TG1, 2GG): SEQ ID NO:378
OLEC2942 (R PAM TG1, 2GG): SEQ ID NO:379
Oligonucleotides for Verification of Plasmid Constructs and Cutting Sites by Sequencing Analysis
ColE1 (pEC85)
oliRN228 (R sequencing): SEQ ID NO:380
speM (pEC287)
OLEC1557 (F sequencing): SEQ ID NO:381
OLEC1556 (R sequencing): SEQ ID NO:382
repDEG-pAMbeta1 (pEC85)
OLEC787 (F sequencing): SEQ ID NO:383

Oligonucleotides for In Vitro Cleavage Assays
crRNA
Spacer 1 crRNA (1-42): SEQ ID NO:384
Spacer 2 crRNA (1-42): SEQ ID NO:385
Spacer 4 crRNA (1-42): SEQ ID NO:386
Spacer 2 crRNA (1-36): SEQ ID NO:387
Spacer 2 crRNA (1-32): SEQ ID NO:388
Spacer 2 crRNA (11-42): SEQ ID NO:389
tracrRNA
(4-89): SEQ ID NO:390
(15-89): SEQ ID NO:391
(23-89): SEQ ID NO:392
(15-53): SEQ ID NO:393
(15-44): SEQ ID NO:394
(15-36): SEQ ID NO:395
(23-53): SEQ ID NO:396
(23-48): SEQ ID NO:397
(23-44): SEQ ID NO:398
(1-26): SEQ ID NO:399
chimeric RNAs
Spacer 1—chimera A: SEQ ID NO:400
Spacer 1—chimera B: SEQ ID NO:401
Spacer 2—chimera A: SEQ ID NO:402
Spacer 2—chimera B: SEQ ID NO:403
Spacer 4—chimera A: SEQ ID NO:404
Spacer 4—chimera B: SEQ ID NO:405
GFP1: SEQ ID NO:406
GFP2: SEQ ID NO:407
GFP3: SEQ ID NO:408
GFP4: SEQ ID NO:409
GFP5: SEQ ID NO:410
DNA Oligonucleotides as Substrates for Cleavage Assays (Protospacer in Bold, PAM Underlined)
protospacer 1—complementary—WT: SEQ ID NO:411
protospacer 1—noncomplementary—WT: SEQ ID NO:412
protospacer 2—complementary—WT: SEQ ID NO:413
protospacer 2—noncomplementary—WT: SEQ ID NO:414
protospacer 4—complementary—WT: SEQ ID NO:415
protospacer 4—noncomplementary—WT: SEQ ID NO:416
protospacer 2—complementary—PAM1: SEQ ID NO:417
protospacer 2—noncomplementary—PAM1: SEQ ID NO:418
protospacer 2—complementary—PAM2: SEQ ID NO:419
protospacer 2—noncomplementary—PAM2: SEQ ID NO:420
protospacer 4—complementary—PAM1: SEQ ID NO:421
protospacer 4—noncomplementary—PAM1: SEQ ID NO:422
protospacer 4—complementary—PAM2: SEQ ID NO:423
protospacer 4—noncomplementary—PAM2: SEQ ID NO:424
In Vitro Transcription and Purification of RNA
RNA was in vitro transcribed using T7 Flash in vitro Transcription Kit (Epicentre, Illumina company) and PCR-generated DNA templates carrying a T7 promoter sequence. RNA was gel-purified and quality-checked prior to use. The primers used for the preparation of RNA templates from *S. pyogenes* SF370, *Listeria* innocua Clip 11262 and *Neisseria meningitidis* A Z2491 are described above.
Protein Purification
The sequence encoding Cas9 (residues 1-1368) was PCR amplified from the genomic DNA of *S. pyogenes* SF370 and inserted into a custom pET-based expression vector using ligation-independent cloning (LIC). The resulting fusion construct contained an N-terminal hexahistidine-maltose binding protein (His6-MBP) tag, followed by a peptide sequence containing a tobacco etch virus (TEV) protease cleavage site. The protein was expressed in *E. coli* strain BL21 Rosetta 2 (DE3) (EMD Biosciences), grown in 2×TY medium at 18° C. for 16 h following induction with 0.2 mM IPTG. The protein was purified by a combination of affinity, ion exchange and size exclusion chromatographic steps. Briefly, cells were lysed in 20 mM Tris pH 8.0, 500 mM NaCl, 1 mM TCEP (supplemented with protease inhibitor cocktail (Roche)) in a homogenizer (Avestin). Clarified lysate was bound in batch to Ni-NTA agarose (Qiagen). The resin was washed extensively with 20 mM Tris pH 8.0, 500 mM NaCl and the bound protein was eluted in 20 mM Tris pH 8.0, 250 mM NaCl, 10% glycerol. The His6-MBP affinity tag was removed by cleavage with TEV protease, while the protein was dialyzed overnight against 20 mM HEPES pH 7.5, 150 mM KCl, 1 mM TCEP, 10% glycerol. The cleaved Cas9 protein was separated from the fusion tag by purification on a 5 ml SP Sepharose HiTrap column (GE Life Sciences), eluting with a linear gradient of 100 mM-1 M KCl. The protein was further purified by size exclusion chromatography on a Superdex 200 16/60 column in 20 mM HEPES pH 7.5, 150 mM KCl and 1 mM TCEP. Eluted protein was concentrated to ~8 mg/ml, flash-frozen in liquid nitrogen and stored at −80° C. Cas9 D10A, H840A and D10A/H840A point mutants were generated using the QuikChange site-directed mutagenesis kit (Agilent) and confirmed by DNA sequencing. The proteins were purified following the same procedure as for the wildtype Cas9 protein.

Cas9 orthologs from Streptococcus thermophilus (LMD-9, YP_820832.1), L. innocua (Clip11262, NP_472073.1), Campylobacter jejuni (subsp. jejuni NCTC 11168, YP_002344900.1) and N. meningitidis (Z2491, YP_002342100.1) were expressed in BL21 Rosetta (DE3) pLysS cells (Novagen) as His6-MBP (N. meningitidis and C. jejuni), His6-Thioredoxin (L. innocua) and His6-GST (S. thermophilus) fusion proteins, and purified essentially as for S. pyogenes Cas9 with the following modifications. Due to large amounts of co-purifying nucleic acids, all four Cas9 proteins were purified by an additional heparin sepharose step prior to gel filtration, eluting the bound protein with a linear gradient of 100 mM-2 M KCl. This successfully removed nucleic acid contamination from the C. jejuni, N. meningitidis and L. innocua proteins, but failed to remove co-purifying nucleic acids from the S. thermophilus Cas9 preparation. All proteins were concentrated to 1-8 mg/ml in 20 mM HEPES pH 7.5, 150 mM KCl and 1 mM TCEP, flash-frozen in liquid N2 and stored at −80° C.

Plasmid DNA Cleavage Assay

Synthetic or in vitro-transcribed tracrRNA and crRNA were pre-annealed prior to the reaction by heating to 95° C. and slowly cooling down to room temperature. Native or restriction digest-linearized plasmid DNA (300 ng (~8 nM)) was incubated for 60 min at 37° C. with purified Cas9 protein (50-500 nM) and tracrRNA:crRNA duplex (50-500 nM, 1:1) in a Cas9 plasmid cleavage buffer (20 mM HEPES pH 7.5, 150 mM KCl, 0.5 mM DTT, 0.1 mM EDTA) with or without 10 mM MgCl$_2$. The reactions were stopped with 5×DNA loading buffer containing 250 mM EDTA, resolved by 0.8 or 1% agarose gel electrophoresis and visualized by ethidium bromide staining. For the Cas9 mutant cleavage assays, the reactions were stopped with 5×SDS loading buffer (30% glycerol, 1.2% SDS, 250 mM EDTA) prior to loading on the agarose gel.

Metal-Dependent Cleavage Assay

Protospacer 2 plasmid DNA (5 nM) was incubated for 1 h at 37° C. with Cas9 (50 nM) pre-incubated with 50 nM tracrRNA:crRNA-sp2 in cleavage buffer (20 mM HEPES pH 7.5, 150 mM KCl, 0.5 mM DTT, 0.1 mM EDTA) supplemented with 1, 5 or 10 mM MgCl$_2$, 1 or 10 mM of MnCl$_2$, CaCl$_2$, ZnCl$_2$, CoCl$_2$, NiSO$_4$ or CuSO$_4$. The reaction was stopped by adding 5×SDS loading buffer (30% glycerol, 1.2% SDS, 250 mM EDTA), resolved by 1% agarose gel electrophoresis and visualized by ethidium bromide staining.

Single-Turnover Assay

Cas9 (25 nM) was pre-incubated 15 min at 37° C. in cleavage buffer (20 mM HEPES pH 7.5, 150 mM KCl, 10 mM MgCl$_2$, 0.5 mM DTT, 0.1 mM EDTA) with duplexed tracrRNA:crRNA-sp2 (25 nM, 1:1) or both RNAs (25 nM) not preannealed and the reaction was started by adding protospacer 2 plasmid DNA (5 nM). The reaction mix was incubated at 37° C. At defined time intervals, samples were withdrawn from the reaction, 5×SDS loading buffer (30% glycerol, 1.2% SDS, 250 mM EDTA) was added to stop the reaction and the cleavage was monitored by 1% agarose gel electrophoresis and ethidium bromide staining. The same was done for the single turnover kinetics without pre-incubation of Cas9 and RNA, where protospacer 2 plasmid DNA (5 nM) was mixed in cleavage buffer with duplex tracrRNA:crRNA-sp2 (25 nM) or both RNAs (25 nM) not pre-annealed, and the reaction was started by addition of Cas9 (25 nM). Percentage of cleavage was analyzed by densitometry and the average of three independent experiments was plotted against time. The data were fit by non-linear regression analysis and the cleavage rates ($k_{obs}$ [min$^{-1}$]) were calculated.

Multiple-Turnover Assay

Cas9 (1 nM) was pre-incubated for 15 min at 37° C. in cleavage buffer (20 mM HEPES pH 7.5, 150 mM KCl, 10 mM MgCl$_2$, 0.5 mM DTT, 0.1 mM EDTA) with pre-annealed tracrRNA:crRNA-sp2 (1 nM, 1:1). The reaction was started by addition of protospacer 2 plasmid DNA (5 nM). At defined time intervals, samples were withdrawn and the reaction was stopped by adding 5×SDS loading buffer (30% glycerol, 1.2% SDS, 250 mM EDTA). The cleavage reaction was resolved by 1% agarose gel electrophoresis, stained with ethidium bromide and the percentage of cleavage was analyzed by densitometry. The results of four independent experiments were plotted against time (min).

Oligonucleotide DNA Cleavage Assay

DNA oligonucleotides (10 pmol) were radiolabeled by incubating with 5 units T4 polynucleotide kinase (New England Biolabs) and ~3-6 pmol (~20-40 mCi) [γ-32P]-ATP (Promega) in 1× T4 polynucleotide kinase reaction buffer at 37° C. for 30 min, in a 50 μL reaction. After heat inactivation (65° C. for 20 min), reactions were purified through an Illustra MicroSpin G-25 column (GE Healthcare) to remove unincorporated label. Duplex substrates (100 nM) were generated by annealing labeled oligonucleotides with equimolar amounts of unlabeled complementary oligonucleotide at 95° C. for 3 min, followed by slow cooling to room temperature. For cleavage assays, tracrRNA and crRNA were annealed by heating to 95° C. for 30 s, followed by slow cooling to room temperature. Cas9 (500 nM final concentration) was pre-incubated with the annealed tracrRNA:crRNA duplex (500 nM) in cleavage assay buffer (20 mM HEPES pH 7.5, 100 mM KCl, 5 mM MgCl$_2$, 1 mM DTT, 5% glycerol) in a total volume of 9 μl. Reactions were initiated by the addition of 1 μl target DNA (10 nM) and incubated for 1 h at 37° C. Reactions were quenched by the addition of 20 μl of loading dye (5 mM EDTA, 0.025% SDS, 5% glycerol in formamide) and heated to 95° C. for 5 min. Cleavage products were resolved on 12% denaturing polyacrylamide gels containing 7 M urea and visualized by phosphorimaging (Storm, GE Life Sciences). Cleavage assays testing PAM requirements (FIG. 13B) were carried out using DNA duplex substrates that had been pre-annealed and purified on an 8% native acrylamide gel, and subsequently radiolabeled at both 5' ends. The reactions were set-up and analyzed as above.

Electrophoretic Mobility Shift Assays

Target DNA duplexes were formed by mixing of each strand (10 nmol) in deionized water, heating to 95° C. for 3 min and slow cooling to room temperature. All DNAs were purified on 8% native gels containing 1×TBE. DNA bands were visualized by UV shadowing, excised, and eluted by soaking gel pieces in DEPC-treated $H_2O$. Eluted DNA was ethanol precipitated and dissolved in DEPC-treated $H_2O$. DNA samples were 5' end labeled with [γ-32P]-ATP using T4 polynucleotide kinase (New England Biolabs) for 30 min at 37° C. PNK was heat denatured at 65° C. for 20 min, and unincorporated radiolabel was removed using an Illustra MicroSpin G-25 column (GE Healthcare). Binding assays were performed in buffer containing 20 mM HEPES pH 7.5, 100 mM KCl, 5 mM $MgCl_2$, 1 mM DTT and 10% glycerol in a total volume of 10 μl. Cas9 D10A/H840A double mutant was programmed with equimolar amounts of pre-annealed tracrRNA:crRNA duplex and titrated from 100 pM to 1 μM. Radiolabeled DNA was added to a final concentration of 20 pM. Samples were incubated for 1 h at 37° C. and resolved at 4° C. on an 8% native polyacrylamide gel containing 1×TBE and 5 mM $MgCl_2$. Gels were dried and DNA visualized by phosphorimaging.

In Silico Analysis of DNA and Protein Sequences

Vector NTI package (Invitrogen) was used for DNA sequence analysis (Vector NTI) and comparative sequence analysis of proteins (AlignX).

In Silico Modeling of RNA Structure and Co-Folding

In silico predictions were performed using the Vienna RNA package algorithms (42, 43). RNA secondary structures and co-folding models were predicted with RNAfold and RNAcofold, respectively and visualized with VARNA (44).

Results

Bacteria and archaea have evolved RNA mediated adaptive defense systems called clustered regularly interspaced short palindromic repeats (CRISPR)/CRISPR-associated (Cas) that protect organisms from invading viruses and plasmids (1-3). We show that in a subset of these systems, the mature crRNA that is base-paired to trans-activating crRNA (tracrRNA) forms a two-RNA structure that directs the CRISPR-associated protein Cas9 to introduce double-stranded (ds) breaks in target DNA. At sites complementary to the crRNA-guide sequence, the Cas9 HNH nuclease domain cleaves the complementary strand, whereas the Cas9 RuvC-like domain cleaves the noncomplementary strand. The dual-tracrRNA:crRNA, when engineered as a single RNA chimera, also directs sequence-specific Cas9 dsDNA cleavage. These studies reveal a family of endonucleases that use dual-RNAs for site-specific DNA cleavage and highlight the ability to exploit the system for RNA-programmable genome editing.

CRISPR/Cas defense systems rely on small RNAs for sequence-specific detection and silencing of foreign nucleic acids. CRISPR/Cas systems are composed of cas genes organized in operon(s) and CRISPR array(s) consisting of genome-targeting sequences (called spacers) interspersed with identical repeats (1-3). CRISPR/Cas-mediated immunity occurs in three steps. In the adaptive phase, bacteria and archaea harboring one or more CRISPR loci respond to viral or plasmid challenge by integrating short fragments of foreign sequence (protospacers) into the host chromosome at the proximal end of the CRISPR array (1-3). In the expression and interference phases, transcription of the repeat spacer element into precursor CRISPR RNA (pre-crRNA) molecules followed by enzymatic cleavage yields the short crRNAs that can pair with complementary protospacer sequences of invading viral or plasmid targets (4-11). Target recognition by crRNAs directs the silencing of the foreign sequences by means of Cas proteins that function in complex with the crRNAs (10, 12-20).

There are three types of CRISPR/Cas systems (21-23). The type I and III systems share some overarching features: specialized Cas endonucleases process the pre-crRNAs, and oncemature, each crRNA assembles into a large multi-Cas protein complex capable of recognizing and cleaving nucleic acids complementary to the crRNA. In contrast, type II systems process precrRNAs by a different mechanism in which a trans-activating crRNA (tracrRNA) complementary to the repeat sequences in pre-crRNA triggers processing by the double-stranded (ds) RNA specific ribonuclease RNase III in the presence of the Cas9 (formerly Csn1) protein (FIG. 15) (4, 24). Cas9 is thought to be the sole protein responsible for crRNA-guided silencing of foreign DNA (25-27).

We show that in type II systems, Cas9 proteins constitute a family of enzymes that require a base-paired structure formed between the activating tracrRNA and the targeting crRNA to cleave target dsDNA. Site-specific cleavage occurs at locations determined by both base-pairing complementarity between the crRNA and the target protospacer DNA and a short motif [referred to as the protospacer adjacent motif (PAM)] juxtaposed to the complementary region in the target DNA. Our study further demonstrates that the Cas9 endonuclease family can be programmed with single RNA molecules to cleave specific DNA sites, thereby facilitating the development of a simple and versatile RNA-directed system to generate dsDNA breaks for genome targeting and editing.

Cas9 is a DNA Endonuclease Guided by Two RNAs

Cas9, the hallmark protein of type II systems, has been hypothesized to be involved in both crRNA maturation and crRNA-guided DNA interference (FIG. 15) (4, 25-27). Cas9 is involved in crRNA maturation (4), but its direct participation in target DNA destruction has not been investigated. To test whether and how Cas9 might be capable of target DNA cleavage, we used an overexpression system to purify Cas9 protein derived from the pathogen *Streptococcus pyogenes* (FIGS. 16A-16B, see supplementary materials and methods) and tested its ability to cleave a plasmid DNA or an oligonucleotide duplex bearing a protospacer sequence complementary to a mature crRNA, and a bona fide PAM. We found that mature crRNA alone was incapable of directing Cas9-catalyzed plasmid DNA cleavage (FIG. 10A and FIG. 17A). However, addition of tracrRNA, which can pair with the repeat sequence of crRNA and is essential to crRNA maturation in this system, triggered Cas9 to cleave plasmid DNA (FIG. 10A and FIG. 17A). The cleavage reaction required both magnesium and the presence of a crRNA sequence complementary to the DNA; a crRNA capable of tracrRNA base pairing but containing a noncognate target DNA-binding sequence did not support Cas9-catalyzed plasmid cleavage (FIG. 10A; FIG. 17A, compare crRNA-sp2 to crRNA-sp1; and FIG. 18A). We obtained similar results with a short linear dsDNA substrate (FIG. 10B and FIGS. 17B and 17C). Thus, the trans-activating tracrRNA is a small noncoding RNA with two critical functions: triggering pre-crRNA processing by the enzyme RNase III (4) and subsequently activating crRNA-guided DNA cleavage by Cas9.

Cleavage of both plasmid and short linear dsDNA by tracrRNA:crRNA-guided Cas9 is sitespecific (FIG. 10C to 10E, and FIGS. 19A and 19B). Plasmid DNA cleavage produced blunt ends at a position three base pairs upstream of the PAM sequence (FIGS. 10C and 10E, and FIGS. 19A and 19C) (26). Similarly, within short dsDNA duplexes, the DNA strand that is complementary to the target-binding sequence in the crRNA (the complementary strand) is cleaved at a site three base pairs upstream of the PAM(FIGS. 10D and 10E, and FIGS. 19B and 19C). The noncomplementary DNA strand is cleaved at one or more sites within three to eight base pairs upstream of the PAM. Further investigation revealed that the noncomplementary strand is first cleaved endonucleolytically and subsequently trimmed by a 3'-5' exonuclease activity (FIG. 18B). The cleavage rates by Cas9 under single-turnover conditions ranged from 0.3 to 1 min-1, comparable to those of restriction endonucleases (FIG. 20A), whereas incubation of wildtype (WT) Cas9-tracrRNA:crRNA complex with a fivefold molar excess of substrate DNA provided evidence that the dual-RNA-guided Cas9 is a multiple-turnover enzyme (FIG. 20B). In contrast to the CRISPR type I Cascade complex (18), Cas9 cleaves both linearized and supercoiled plasmids (FIGS. 10A and 11A). Therefore, an invading plasmid can, in principle, be cleaved multiple times by Cas9 proteins programmed with different crRNAs.

(FIG. 10A) Cas9 was programmed with a 42-nucleotide crRNA-sp2 (crRNA containing a spacer 2 sequence) in the presence or absence of 75-nucleotide tracrRNA. The complex was added to circular or XhoI-linearized plasmid DNA bearing a sequence complementary to spacer 2 and a functional PAM. crRNA-sp1, specificity control; M, DNA marker; kbp, kilo-base pair. See FIG. 17A. (FIG. 10B) Cas9 was programmed with crRNA-sp2 and tracrRNA (nucleotides 4 to 89). The complex was incubated with double- or single-stranded DNAs harboring a sequence complementary to spacer 2 and a functional PAM (4). The complementary or noncomplementary strands of the DNA were 5'-radiolabeled and annealed with a nonlabeled partner strand. nt, nucleotides. See FIGS. 17B and 17C. (FIG. 10C) Sequencing analysis of cleavage products from FIG. 10A. Termination of primer extension in the sequencing reaction indicates the position of the cleavage site. The 3' terminal A overhang (asterisks) is an artifact of the sequencing reaction. See FIGS. 19A and 19C. (FIG. 10D) The cleavage products from FIG. 10B were analyzed alongside 5' end-labeled size markers derived from the complementary and noncomplementary strands of the target DNA duplex. M, marker; P, cleavage product. See FIGS. 19B and 19C (FIG. 10E) Schematic representation of tracrRNA, crRNA-sp2, and protospacer 2 DNA sequences. Regions of crRNA complementarity to tracrRNA (overline) and the protospacer DNA (underline) are represented. The PAM sequence is labeled; cleavage sites mapped in (FIG. 10C) and (FIG. 10D) are represented by white-filled arrows (FIG. 10C), a black-filled arrow [(FIG. 10D), complementary strand], and a black bar [(FIG. 10D), noncomplementary strand].

FIG. 15 depicts the type II RNA-mediated CRISPR/Cas immune pathway. The expression and interference steps are represented in the drawing. The type II CRISPR/Cas loci are composed of an operon of four genes encoding the proteins Cas9, Cas1, Cas2 and Csn2, a CRISPR array consisting of a leader sequence followed by identical repeats (black rectangles) interspersed with unique genome-targeting spacers (diamonds) and a sequence encoding the trans-activating tracrRNA. Represented here is the type II CRISPR/Cas locus of S. pyogenes SF370 (Accession number NC_002737) (4). Experimentally confirmed promoters and transcriptional terminator in this locus are indicated (4). The CRISPR array is transcribed as a precursor CRISPR RNA (pre-crRNA) molecule that undergoes a maturation process specific to the type II systems (4). In S. pyogenes SF370, tracrRNA is transcribed as two primary transcripts of 171 and 89 nt in length that have complementarity to each repeat of the pre-crRNA. The first processing event involves pairing of tracrRNA to pre-crRNA, forming a duplex RNA that is recognized and cleaved by the housekeeping endoribonuclease RNase III in the presence of the Cas9 protein. RNase III-mediated cleavage of the duplex RNA generates a 75-nt processed tracrRNA and a 66-nt intermediate crRNAs consisting of a central region containing a sequence of one spacer, flanked by portions of the repeat sequence. A second processing event, mediated by unknown ribonuclease(s), leads to the formation of mature crRNAs of 39 to 42 nt in length consisting of 5'-terminal spacer-derived guide sequence and repeat-derived 3'-terminal sequence. Following the first and second processing events, mature tracrRNA remains paired to the mature crRNAs and bound to the Cas9 protein. In this ternary complex, the dual tracrRNA:crRNA structure acts as guide RNA that directs the endonuclease Cas9 to the cognate target DNA. Target recognition by the Cas9-tracrRNA:crRNA complex is initiated by scanning the invading DNA molecule for homology between the protospacer sequence in the target DNA and the spacer-derived sequence in the crRNA. In addition to the DNA protospacer-crRNA spacer complementarity, DNA targeting requires the presence of a short motif (NGG, where N can be any nucleotide) adjacent to the protospacer (protospacer adjacent motif—PAM). Following pairing between the dual-RNA and the protospacer sequence, an R-loop is formed and Cas9 subsequently introduces a double-stranded break (DSB) in the DNA. Cleavage of target DNA by Cas9 requires two catalytic domains in the protein. At a specific site relative to the PAM, the HNH domain cleaves the complementary strand of the DNA while the RuvC-like domain cleaves the noncomplementary strand.

(FIG. 16A) S. pyogenes Cas9 was expressed in E. coli as a fusion protein containing an N-terminal His6-MBP tag and purified by a combination of affinity, ion exchange and size exclusion chromatographic steps. The affinity tag was removed by TEV protease cleavage following the affinity purification step. Shown is a chromatogram of the final size exclusion chromatography step on a Superdex 200 (16/60) column. Cas9 elutes as a single monomeric peak devoid of contaminating nucleic acids, as judged by the ratio of absorbances at 280 and 260 nm Inset; eluted fractions were resolved by SDS-PAGE on a 10% polyacrylamide gel and stained with SimplyBlue Safe Stain (Invitrogen). (FIG. 16B) SDS-PAGE analysis of purified Cas9 orthologs. Cas9 orthologs were purified as described in Supplementary Materials and Methods. 2.5 µg of each purified Cas9 were analyzed on a 4-20% gradient polyacrylamide gel and stained with SimplyBlue Safe Stain.

FIG. 17A-17C (also see FIG. 10A-10E). The protospacer 1 sequence originates from S. pyogenes SF370 (M1) SPy_0700, target of S. pyogenes SF370 crRNAsp1 (4). Here, the protospacer 1 sequence was manipulated by changing the PAM from a nonfunctional sequence (TTG) to a functional one (TGG). The protospacer 4 sequence originates from S. pyogenes MGAS10750 (M4) MGAS10750_Spy1285, target of S. pyogenes SF370 crRNA-sp4 (4). (FIG. 17A) Protospacer 1 plasmid DNA cleavage guided by cognate tracrRNA:crRNA duplexes. The cleavage products were resolved by agarose gel electrophoresis and visualized by ethidium bromide staining M, DNA marker; fragment sizes in base pairs are indicated. (FIG.

17B) Protospacer 1 oligonucleotide DNA cleavage guided by cognate tracrRNA:crRNA-sp1 duplex. The cleavage products were resolved by denaturing polyacrylamide gel electrophoresis and visualized by phosphorimaging. Fragment sizes in nucleotides are indicated. (FIG. 17C) Protospacer 4 oligonucleotide DNA cleavage guided by cognate tracrRNA:crRNA-sp4 duplex. The cleavage products were resolved by denaturing polyacrylamide gel electrophoresis and visualized by phosphorimaging. Fragment sizes in nucleotides are indicated. (FIG. 17A, FIG. 17 B, FIG. 17C) Experiments in FIG. 17A were performed as in FIG. 10A; in FIG. 17B and in FIG. 17C as in FIG. 10B. (FIG. 17B, FIG. 17C) A schematic of the tracrRNA:crRNAtarget DNA interaction is shown below. The regions of crRNA complementarity to tracrRNA and the protospacer DNA are overlined and underlined, respectively. The PAM sequence is labeled.

FIG. 18 (also see FIG. 10A-10E). (FIG. 18A) Protospacer 2 plasmid DNA was incubated with Cas9 complexed with tracrRNA:crRNA-sp2 in the presence of different concentrations of $Mg^{2+}$, $Mn^{2+}$, $Ca^{2+}$, $Zn^{2+}$, $Co^{2+}$, $Ni^{2+}$ or $Cu^{2+}$. The cleavage products were resolved by agarose gel electrophoresis and visualized by ethidium bromide staining Plasmid forms are indicated. (FIG. 18B) A protospacer 4 oligonucleotide DNA duplex containing a PAM motif was annealed and gel-purified prior to radiolabeling at both 5' ends. The duplex (10 nM final concentration) was incubated with Cas9 programmed with tracrRNA (nucleotides 23-89) and crRNAsp4 (500 nM final concentration, 1:1). At indicated time points (min), 10 µl aliquots of the cleavage reaction were quenched with formamide buffer containing 0.025% SDS and 5 mM EDTA, and analyzed by denaturing polyacrylamide gel electrophoresis as in FIG. 10B. Sizes in nucleotides are indicated.

(FIG. 19A) Mapping of protospacer 1 plasmid DNA cleavage. Cleavage products from FIG. 17A were analyzed by sequencing as in FIG. 10C. Note that the 3' terminal A overhang (asterisk) is an artifact of the sequencing reaction. (FIG. 19B) Mapping of protospacer 4 oligonucleotide DNA cleavage. Cleavage products from FIG. 17C were analyzed by denaturing polyacrylamide gel electrophoresis alongside 5' endlabeled oligonucleotide size markers derived from the complementary and noncomplementary strands of the protospacer 4 duplex DNA. M, marker; P, cleavage product. Lanes 1-2: complementary strand. Lanes 3-4: non-complementary strand. Fragment sizes in nucleotides are indicated. (FIG. 19C) Schematic representations of tracrRNA, crRNAsp1 and protospacer 1 DNA sequences (top) and tracrRNA, crRNAsp4 and protospacer 4 DNA sequences (bottom). tracrRNA:crRNA forms a dual-RNA structure directed to complementary protospacer DNA through crRNA-protospacer DNA pairing. The regions of crRNA complementary to tracrRNA and the protospacer DNA are overlined and underlined, respectively. The cleavage sites in the complementary and noncomplementary DNA strands mapped in (FIG. 19A) (top) and (FIG. 19B) (bottom) are represented with arrows (FIG. 19A and FIG. 19B, complementary strand) and a black bar (FIG. 19B, noncomplementary strand) above the sequences, respectively.

(FIG. 20A) Single turnover kinetics of Cas9 under different RNA pre-annealing and protein-RNA pre-incubation conditions. Protospacer 2 plasmid DNA was incubated with either Cas9 pre-incubated with pre-annealed tracrRNA:crRNA-sp2 (o), Cas9 not pre-incubated with pre-annealed tracrRNA:crRNA-sp2 (●), Cas9 pre-incubated with not pre-annealed tracrRNA and crRNA-sp2 (□) or Cas9 not pre-incubated with not pre-annealed RNAs (■). The cleavage activity was monitored in a time-dependent manner and analyzed by agarose gel electrophoresis followed by ethidium bromide staining. The average percentage of cleavage from three independent experiments is plotted against the time (min) and fitted with a nonlinear regression. The calculated cleavage rates ($k_{obs}$) are shown in the table. The results suggest that the binding of Cas9 to the RNAs is not rate-limiting under the conditions tested. Plasmid forms are indicated. The obtained $k_{obs}$ values are comparable to those of restriction endonucleases which are typically of the order of 1-10 per min (45-47). (FIG. 20B) Cas9 is a multiple turnover endonuclease. Cas9 loaded with duplexed tracrRNA:crRNA-sp2 (1 nM, 1:1:1—indicated with gray line on the graph) was incubated with a 5-fold excess of native protospacer 2 plasmid DNA. Cleavage was monitored by withdrawing samples from the reaction at defined time intervals (0 to 120 min) followed by agarose gel electrophoresis analysis (top) and determination of cleavage product amount (nM) (bottom). Standard deviations of three independent experiments are indicated. In the time interval investigated, 1 nM Cas9 was able to cleave ~2.5 nM plasmid DNA.

Each Cas9 Nuclease Domain Cleaves One DNA Strand

Cas9 contains domains homologous to both HNH and RuvC endonucleases (FIG. 11A and FIG. 3A and FIG. 3B) (21-23, 27, 28). We designed and purified Cas9 variants containing inactivating point mutations in the catalytic residues of either the HNH or RuvC-like domains (FIG. 11A and FIG. 3A and FIG. 3B) (23, 27). Incubation of these variant Cas9 proteins with native plasmid DNA showed that dualRNA-guided mutant Cas9 proteins yielded nicked open circular plasmids, whereas the WT Cas9 protein-tracrRNA:crRNA complex produced a linear DNA product (FIG. 10A and FIG. 11A and FIG. 17A and FIG. 25A). This result indicates that the Cas9 HNH and RuvC-like domains each cleave one plasmid DNA strand. To determine which strand of the target DNA is cleaved by each Cas9 catalytic domain, we incubated the mutant Cas9-tracrRNA:crRNA complexes with short dsDNA substrates in which either the complementary or noncomplementary strand was radiolabeled at its 5' end. The resulting cleavage products indicated that the Cas9 HNH domain cleaves the complementary DNA strand, whereas the Cas9 RuvC-like domain cleaves the noncomplementary DNA strand (FIG. 11B and FIG. 21B).

(FIG. 11A) (Top) Schematic representation of Cas9 domain structure showing the positions of domain mutations. D10A, Asp10→Ala10; H840A; His840→Ala840. Complexes of WT or nuclease mutant Cas9 proteins with tracrRNA: crRNA-sp2 were assayed for endonuclease activity as in FIG. 10A. (FIG. 11B) Complexes of WT Cas9 or nuclease domain mutants with tracrRNA and crRNA-sp2 were tested for activity as in FIG. 10B.

FIG. 3A and FIG. 3B The amino-acid sequence of Cas9 from *S. pyogenes* (SEQ ID NO:8) is represented. Cas9/Csn1 proteins from various diverse species have 2 domains that include motifs homologous to both HNH and RuvC endonucleases. (FIG. 3A) Motifs 1-4 (motif numbers are marked on left side of sequence) are shown for *S. pyogenes* Cas9/Csn1. The three predicted RuvC-like motifs (1, 2, 4) and the predicted HNH motif (3) are overlined. Residues Asp10 and His840, which were substituted by Ala in this study are highlighted by an asterisk above the sequence. Underlined residues are highly conserved among Cas9 proteins from different species. Mutations in underlined residues are likely to have functional consequences on Cas9 activity. Note that in the present study coupling of the two nuclease-like activities is experimentally demonstrated (FIGS. 11A-11B and FIGS. 21A-21B). (FIG. 3B) Domains 1 (amino acids 7-166) and 2 (amino acids 731-1003), which include motifs 1-4, are depicted for *S. pyogenes* Cas9/Csn1. Refer to Table 1 and FIG. 5 for additional information.

FIG. 21A-21B Protospacer DNA cleavage by cognate tracrRNA:crRNA-directed Cas9 mutants containing mutations in the HNH or RuvC-like domain. (FIG. 21A) Protospacer 1 plasmid DNA cleavage. The experiment was performed as in FIG. 11A. Plasmid DNA conformations and sizes in base pairs are indicated. (FIG. 21B) Protospacer 4 oligonucleotide DNA cleavage. The experiment was performed as in FIG. 11B. Sizes in nucleotides are indicated.
Dual-RNA Requirements for Target DNA Binding and Cleavage tracrRNA might be required for targetDNA binding and/or to stimulate the nuclease activity of Cas9 downstream of target recognition. To distinguish between these possibilities, we used an electrophoretic mobility shift assay to monitor target DNA binding by catalytically inactive Cas9 in the presence or absence of crRNA and/or tracrRNA. Addition of tracrRNA substantially enhanced target DNA binding by Cas9, whereas we observed little specific DNA binding with Cas9 alone or Cas9-crRNA (FIG. 22). This indicates that tracrRNA is required for target DNA recognition, possibly by properly orienting the crRNA for interaction with the complementary strand of target DNA. The predicted tracrRNA:crRNA secondary structure includes base pairing between the 22 nucleotides at the 3' terminus of the crRNA and a segment near the 5' end of the mature tracrRNA (FIG. 10E). This interaction creates a structure in which the 5'-terminal 20 nucleotides of the crRNA, which vary in sequence in different crRNAs, are available for target DNA binding. The bulk of the tracrRNA downstream of the crRNA basepairing region is free to form additional RNA structure(s) and/or to interact with Cas9 or the target DNA site. To determine whether the entire length of the tracrRNA is necessary for sitespecific Cas9-catalyzed DNA cleavage, we tested Cas9-tracrRNA:crRNA complexes reconstituted using full-length mature (42-nucleotide) crRNA and various truncated forms of tracrRNA lacking sequences at their 5' or 3' ends. These complexes were tested for cleavage using a short target dsDNA. A substantially truncated version of the tracrRNA retaining nucleotides 23 to 48 of the native sequence was capable of supporting robust dual-RNA-guided Cas9-catalyzed DNA cleavage (FIG. 12A and FIG. 12C, and FIG. 23A and FIG. 23B). Truncation of the crRNA from either end showed that Cas9-catalyzed cleavage in the presence of tracrRNA could be triggered with crRNAs missing the 3'-terminal 10 nucleotides (FIG. 12B and FIG. 12C). In contrast, a 10-nucleotide deletion from the 5' end of crRNA abolished DNA cleavage by Cas9 (FIG. 12B). We also analyzed Cas9 orthologs from various bacterial species for their ability to support *S. pyogenes* tracrRNA:crRNA-guided DNA cleavage. In contrast to closely related *S. pyogenes* Cas9 orthologs, more distantly related orthologs were not functional in the cleavage reaction (FIG. 24A-24D). Similarly, *S. pyogenes* Cas9 guided by tracrRNA:crRNA duplexes originating from more distant systems was unable to cleave DNA efficiently (FIG. 24A-24D). Species specificity of dual-RNA-guided cleavage of DNA indicates coevolution of Cas9, tracrRNA, and the crRNA repeat, as well as the existence of a still unknown structure and/or sequence in the dual-RNA that is critical for the formation of the ternary complex with specific Cas9 orthologs.

Figure 12E:
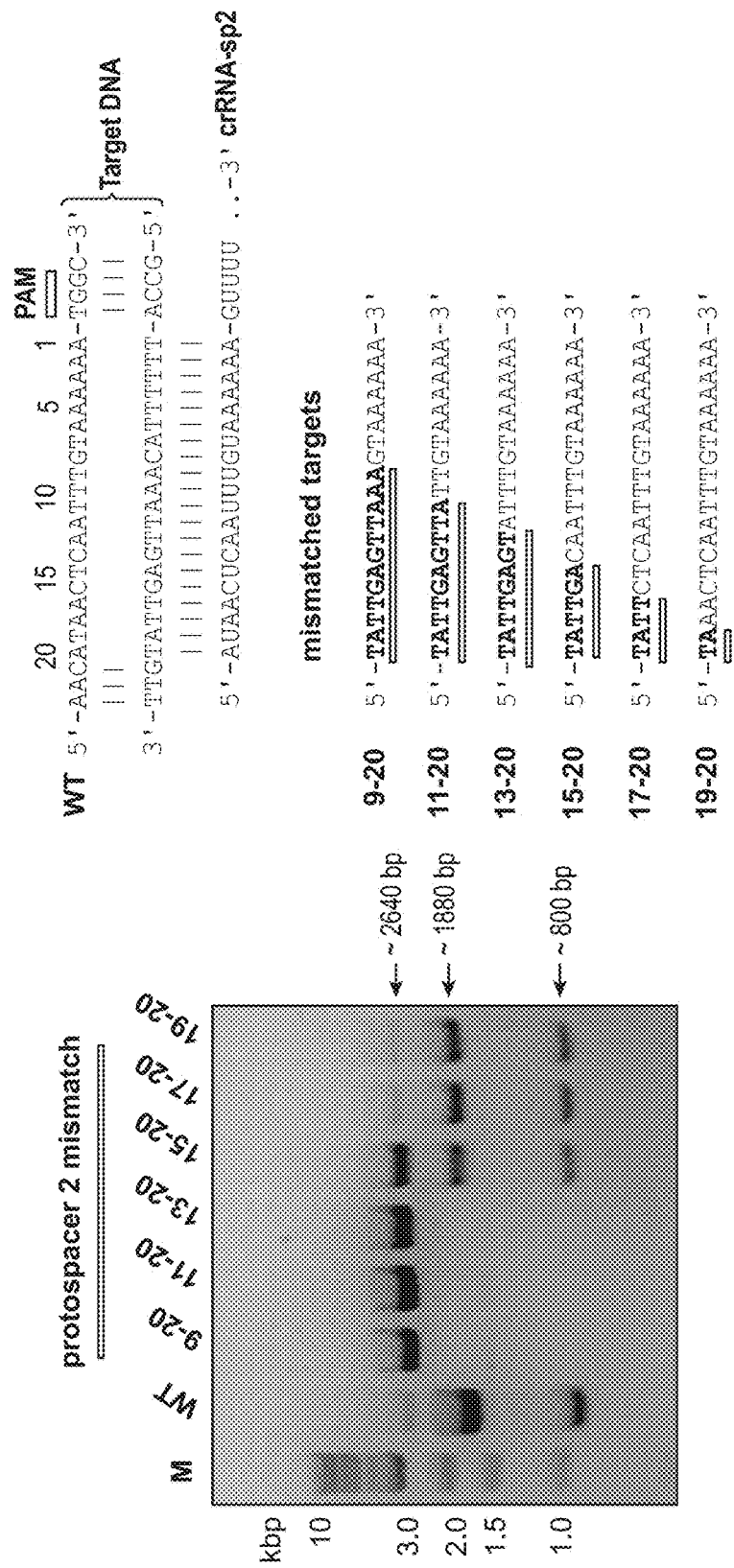

To investigate the protospacer sequence requirements for type II CRISPR/Cas immunity in bacterial cells, we analyzed a series of protospacer-containing plasmid DNAs harboring single-nucleotide mutations for their maintenance following transformation in *S. pyogenes* and their ability to be cleaved by Cas9 in vitro. In contrast to point mutations introduced at the 5' end of the protospacer, mutations in the region close to the PAM and the Cas9 cleavage sites were not tolerated in vivo and resulted in decreased plasmid cleavage efficiency in vitro (FIG. 12D). Our results are in agreement with a previous report of protospacer escape mutants selected in the type II CRISPR system from *S. thermophilus* in vivo (27, 29). Furthermore, the plasmid maintenance and cleavage results hint at the existence of a "seed" region located at the 3' end of the protospacer sequence that is crucial for the interaction with crRNA and subsequent cleavage by Cas9. In support of this notion, Cas9 enhanced complementary DNA strand hybridization to the crRNA; this enhancement was the strongest in the 3'-terminal region of the crRNA targeting sequence (FIG. 25A-25C). Corroborating this finding, a contiguous stretch of at least 13 base pairs between the crRNA and the target DNA site proximal to the PAM is required for efficient target cleavage, whereas up to six contiguous mismatches in the 5'-terminal region of the protospacer are tolerated (FIG. 12E). These findings are reminiscent of the previously observed seed-sequence requirements for target nucleic acid recognition in Argonaute proteins (30, 31) and the Cascade and Csy CRISPR complexes (13, 14).

(FIG. 12A) Cas9-tracrRNA: crRNA complexes were reconstituted using 42-nucleotide crRNA-sp2 and truncated tracrRNA constructs and were assayed for cleavage activity as in FIG. 10B. (FIG. 12B) Cas9 programmed with full-length tracrRNA and crRNA-sp2 truncations was assayed for activity as in (FIG. 12A). (FIG. 12C) Minimal regions of tracrRNA and crRNA capable of guiding Cas9-mediated DNA cleavage (shaded region). (FIG. 12D) Plasmids containing WT or mutant protospacer 2 sequences with indicated point mutations were cleaved in vitro by programmed Cas9 as in FIG. 10A and used for transformation assays of WT or pre-crRNA-deficient *S. pyogenes*. The transformation efficiency was calculated as colony-forming units (CFU) per microgram of plasmid DNA. Error bars represent SDs for three biological replicates. (FIG. 12E) Plasmids containing WT and mutant protospacer 2 inserts with varying extent of crRNA-target DNA mismatches (bottom) were cleaved in vitro by programmed Cas9 (top). The cleavage reactions were further digested with XmnI. The 1880- and 800-bp fragments are Cas9-generated cleavage products. M, DNA marker.

FIG. 22 Electrophoretic mobility shift assays were performed using protospacer 4 target DNA duplex and Cas9 (containing nuclease domain inactivating mutations D10A and H840) alone or in the presence of crRNA-sp4, tracrRNA (75 nt), or both. The target DNA duplex was radiolabeled at both 5' ends. Cas9 (D10/H840A) and complexes were titrated from 1 nM to 1 μM. Binding was analyzed by 8% native polyacrylamide gel electrophoresis and visualized by phosphorimaging. Note that Cas9 alone binds target DNA with moderate affinity. This binding is unaffected by the addition of crRNA, suggesting that this represents sequence nonspecific interaction with the dsDNA. Furthermore, this interaction can be outcompeted by tracrRNA alone in the absence of crRNA. In the presence of both crRNA and tracrRNA, target DNA binding is substantially enhanced and yields a species with distinct electrophoretic mobility, indicative of specific target DNA recognition.

FIG. 23A-23B A fragment of tracrRNA encompassing a part of the crRNA paired region and a portion of the downstream region is sufficient to direct cleavage of protospacer oligonucleotide DNA by Cas9. (FIG. 23A) Protospacer 1 oligonucleotide DNA cleavage and (FIG. 23B) Protospacer 4 oligonucleotide DNA cleavage by Cas9 guided with a mature cognate crRNA and various tracrRNA fragments. (FIG. 23A, FIG. 23B) Sizes in nucleotides are indicated.

FIG. 24A-24D Like Cas9 from S. pyogenes, the closely related Cas9 orthologs from the Gram-positive bacteria L. innocua and S. thermophilus cleave protospacer DNA when targeted by tracrRNA:crRNA from S. pyogenes. However, under the same conditions, DNA cleavage by the less closely related Cas9 orthologs from the Gramnegative bacteria C. jejuni and N. meningitidis is not observed. Spy, S. pyogenes SF370 (Accession Number NC_002737); Sth, S. thermophilus LMD-9 (STER_1477 Cas9 ortholog; Accession Number NC_008532); Lin, L. innocua Clip11262 (Accession Number NC_003212); Cje, C. jejuni NCTC 11168 (Accession Number NC_002163); Nme, N. meningitidis A Z2491 (Accession Number NC_003116). (FIG. 24A) Cleavage of protospacer plasmid DNA. Protospacer 2 plasmid DNA (300 ng) was subjected to cleavage by different Cas9 orthologs (500 nM) guided by hybrid tracrRNA:crRNA-sp2 duplexes (500 nM, 1:1) from different species. To design the RNA duplexes, we predicted tracrRNA sequences from L. innocua and N. meningitidis based on previously published Northern blot data (4). The dual-hybrid RNA duplexes consist of species specific tracrRNA and a heterologous crRNA. The heterologous crRNA sequence was engineered to contain S. pyogenes DNA-targeting sp2 sequence at the 5' end fused to L. innocua or N. meningitidis tracrRNA-binding repeat sequence at the 3' end. Cas9 orthologs from S. thermophilus and L. innocua, but not from N. meningitidis or C. jejuni, can be guided by S. pyogenes tracrRNA:crRNA-sp2 to cleave protospacer 2 plasmid DNA, albeit with slightly decreased efficiency. Similarly, the hybrid L. innocua tracrRNA:crRNA-sp2 can guide S. pyogenes Cas9 to cleave the target DNA with high efficiency, whereas the hybrid N. meningitidis tracrRNA:crRNA-sp2 triggers only slight DNA cleavage activity by S. pyogenes Cas9. As controls, N. meningitidis and L. innocua Cas9 orthologs cleave protospacer 2 plasmid DNA when guided by the cognate hybrid tracrRNA:crRNA-sp2. Note that as mentioned above, the tracrRNA sequence of N. meningitidis is predicted only and has not yet been confirmed by RNA sequencing. Therefore, the low efficiency of cleavage could be the result of either low activity of the Cas9 orthologs or the use of a nonoptimally designed tracrRNA sequence. (FIG. 24B) Cleavage of protospacer oligonucleotide DNA. 5'-end radioactively labeled complementary strand oligonucleotide (10 nM) pre-annealed with unlabeled noncomplementary strand oligonucleotide (protospacer 1) (10 nM) (left) or 5'-end radioactively labeled noncomplementary strand oligonucleotide (10 nM) pre-annealed with unlabeled complementary strand oligonucleotide (10 nM) (right) (protospacer 1) was subjected to cleavage by various Cas9 orthologs (500 nM) guided by tracrRNA:crRNA-sp1 duplex from S. pyogenes (500 nM, 1:1). Cas9 orthologs from S. thermophilus and L. innocua, but not from N. meningitidis or C. jejuni can be guided by S. pyogenes cognate dual-RNA to cleave the protospacer oligonucleotide DNA, albeit with decreased efficiency. Note that the cleavage site on the complementary DNA strand is identical for all three orthologs. Cleavage of the noncomplementary strand occurs at distinct positions. (FIG. 24C) Amino acid sequence identity of Cas9 orthologs. S. pyogenes, S. thermophilus and L. innocua Cas9 orthologs share high percentage of amino acid identity. In contrast, the C. jejuni and N. meningitidis Cas9 proteins differ in sequence and length (~300-400 amino acids shorter). (FIG. 24D) Co-foldings of engineered species-specific heterologous crRNA sequences with the corresponding tracrRNA orthologs from S. pyogenes (experimentally confirmed, (4)), L. innocua (predicted) or N. meningitidis (predicted). tracrRNAs; crRNA spacer 2 fragments; and crRNA repeat fragments are traced and labeled. L. innocua and S. pyogenes hybrid tracrRNA:crRNA-sp2 duplexes share very similar structural characteristics, albeit distinct from the N. meningitidis hybrid tracrRNA:crRNA. Together with the cleavage data described above in FIG. 24A and FIG. 24B, the co-folding predictions would indicate that the species-specificity cleavage of target DNA by Cas9-tracrRNA:crRNA is dictated by a still unknown structural feature in the tracrRNA:crRNA duplex that is recognized specifically by a cognate Cas9 ortholog. It was predicted that the species-specificity of cleavage observed in FIG. 24A and FIG. 24B occurs at the level of binding of Cas9 to dual-tracrRNA:crRNA. Dual-RNA guided Cas9 cleavage of target DNA can be species specific. Depending on the degree of diversity/evolution among Cas9 proteins and tracrRNA:crRNA duplexes, Cas9 and dual-RNA orthologs are partially interchangeable.

FIG. 25A-25C A series of 8-nucleotide DNA probes complementary to regions in the crRNA encompassing the DNA-targeting region and tracrRNA-binding region were analyzed for their ability to hybridize to the crRNA in the context of a tracrRNA:crRNA duplex and the Cas9-tracrRNA:crRNA ternary complex. (FIG. 25A) Schematic representation of the sequences of DNA probes used in the assay and their binding sites in crRNA-sp4. (FIG. 25B-FIG. 25C) Electrophoretic mobility shift assays of target DNA probes with tracrRNA:crRNA-sp4 or Cas9-tracrRNA:crRNA-sp4. The tracrRNA(15-89) construct was used in the experiment. Binding of the duplexes or complexes to target oligonucleotide DNAs was analyzed on a 16% native polyacrylamide gel and visualized by phosphorimaging.

A Short Sequence Motif Dictates R-Loop Formation

In multiple CRISPR/Cas systems, recognition of self versus nonself has been shown to involve a short sequence motif that is preserved in the foreign genome, referred to as the PAM(27, 29, 32-34). PAM motifs are only a few base pairs in length, and their precise sequence and position vary according to the CRISPR/Cas system type (32). In the S. pyogenes type II system, the PAM conforms to an NGG consensus sequence, containing two G:C base pairs that occur one base pair downstream of the crRNA binding sequence, within the target DNA (4). Transformation assays demonstrated that the GG motif is essential for protospacer plasmid DNA elimination by CRISPR/Cas in bacterial cells (FIG. 26A), consistent with previous observations in S. thermophilus (27). The motif is also essential for in vitro protospacer plasmid cleavage by tracrRNA:crRNA-guided Cas9 (FIG. 26B). To determine the role of the PAM in target DNA cleavage by the Cas9-tracrRNA: crRNA complex, we tested a series of dsDNA duplexes containing mutations in the PAM sequence on the complementary or noncomplementary strands, or both (FIG. 13A). Cleavage assays using these substrates showed that Cas9-catalyzed DNA cleavage was particularly sensitive to mutations in the PAM sequence on the noncomplementary strand of the DNA, in contrast to complementary strand PAM recognition by type I CRISPR/Cas systems (18, 34). Cleavage of target single-stranded DNAs was unaffected by mutations of the PAM motif. This observation suggests that the PAM motif is required only in the context of target dsDNA and may thus be required to license duplex unwinding, strand invasion, and the formation of an R-loop structure. When we used a different crRNA-target DNA pair (crRNA-sp4 and protospacer 4 DNA), selected due to the presence of a canonical PAM not present in the protospacer 2 target DNA, we found that both G nucleotides of the PAM were required for efficient Cas9-catalyzed DNA cleavage (FIG. 13B and FIG. 26C). To determine whether the PAM plays a direct role in recruiting the Cas9-tracrRNA:crRNA complex to the correct target DNA site, we analyzed binding affinities of the complex for target DNA sequences by native gel mobility shift assays (FIG. 13C). Mutation of either G in the PAM sequence substantially reduced the affinity of Cas9-tracrRNA: crRNA for the target DNA. This finding illustrates a role for the PAM sequence in target DNA binding by Cas9.

(FIG. 13A) Dual RNA-programmed Cas9 was tested for activity as in FIG. 10B. WT and mutant PAM sequences in target DNAs are indicated with lines. (FIG. 13B) Protospacer 4 target DNA duplexes (labeled at both 5' ends) containing WT and mutant PAM motifs were incubated with Cas9 programmed with tracrRNA:crRNA-sp4 (nucleotides 23 to 89). At the indicated time points (in minutes), aliquots of the cleavage reaction were taken and analyzed as in FIG. 10B. (FIG. 13C) Electrophoretic mobility shift assays were performed using RNA-programmed Cas9 (D10A/H840A) and protospacer 4 target DNA duplexes [same as in FIG. 13B] containing WT and mutated PAM motifs. The Cas9 (D10A/H840A)-RNA complex was titrated from 100 pM to 1 mM.

(FIG. 26A) Mutations of the PAM sequence in protospacer 2 plasmid DNA abolish interference of plasmid maintenance by the Type II CRISPR/Cas system in bacterial cells. Wild-type protospacer 2 plasmids with a functional or mutated PAM were transformed into wild-type (strain SF370, also named EC904) and pre-crRNA-deficient mutant (EC1479) S. pyogenes as in FIG. 12D. PAM mutations are not tolerated by the Type II CRISPR/Cas system in vivo. The mean values and standard deviations of three biological replicates are shown. (FIG. 26B) Mutations of the PAM sequence in protospacer plasmid DNA abolishes cleavage by Cas9-tracrRNA:crRNA. Wild type protospacer 2 plasmid with a functional or mutated PAM were subjected to Cas9 cleavage as in FIG. 10A. The PAM mutant plasmids are not cleaved by the Cas9-tracrRNA:crRNA complex. (FIG. 26C) Mutations of the canonical PAM sequence abolish interference of plasmid maintenance by the Type II CRISPR/Cas system in bacterial cells. Wild-type protospacer 4 plasmids with a functional or mutated PAM were cleaved with Cas9 programmed with tracrRNA and crRNA-sp2. The cleavage reactions were carried out in the presence of the XmnI restriction endonuclease to visualize the Cas9 cleavage products as two fragments (~1880 and ~800 bp). Fragment sizes in base pairs are indicated.

Cas9 can be Programmed with a Single Chimeric RNA

Examination of the likely secondary structure of the tracrRNA:crRNA duplex (FIGS. 10E and 12C) suggested the possibility that the features required for site-specific Cas9-catalyzed DNA cleavage could be captured in a single chimeric RNA. Although the tracrRNA:crRNA target-selection mechanism works efficiently in nature, the possibility of a single RNA-guided Cas9 is appealing due to its potential utility for programmed DNA cleavage and genome editing (FIG. 1A-1B). We designed two versions of a chimeric RNA containing a target recognition sequence at the 5' end followed by a hairpin structure retaining the base-pairing interactions that occur between the tracrRNA and the crRNA (FIG. 14A). This single transcript effectively fuses the 3' end of crRNA to the 5' end of tracrRNA, thereby mimicking the dual-RNA structure required to guide site-specific DNA cleavage by Cas9. In cleavage assays using plasmid DNA, we observed that the longer chimeric RNA was able to guide Cas9-catalyzed DNA cleavage in a manner similar to that observed for the truncated tracrRNA:crRNA duplex (FIG. 14A and FIG. 27A and FIG. 27C). The shorter chimeric RNA did not work efficiently in this assay, confirming that nucleotides that are 5 to 12 positions beyond the tracrRNA: crRNA base-pairing interaction are important for efficient Cas9 binding and/or target recognition. We obtained similar results in cleavage assays using short dsDNA as a substrate, further indicating that the position of the cleavage site in target DNA is identical to that observed using the dual tracrRNA:crRNA as a guide (FIG. 14B and FIG. 27B and FIG. 27C). Finally, to establish whether the design of chimeric RNA might be universally applicable, we engineered five different chimeric guide RNAs to target a portion of the gene encoding the green-fluorescent protein (GFP) (FIG. 28A to 28C) and tested their efficacy against a plasmid carrying the GFP coding sequence in vitro. In all five cases, Cas9 programmed with these chimeric RNAs efficiently cleaved the plasmid at the correct target site (FIG. 14C and FIG. 28D), indicating that rational design of chimeric RNAs is robust and could, in principle, enable targeting of any DNA sequence of interest with few constraints beyond the presence of a GG dinucleotide adjacent to the targeted sequence.

FIG. 1A-1B A DNA-targeting RNA comprises a single stranded "DNA-targeting segment" and a "protein-binding segment," which comprises a stretch of double stranded RNA. (FIG. 1A) A DNA-targeting RNA can comprise two separate RNA molecules (referred to as a "double-molecule" or "two-molecule" DNA-targeting RNA). A double-molecule DNA-targeting RNA comprises a "targeter-RNA" and an "activator-RNA." (FIG. 1B) A DNA-targeting RNA can comprise a single RNA molecule (referred to as a "single-molecule" DNA-targeting RNA). A single-molecule DNA-targeting RNA comprises "linker nucleotides."

(FIG. 14A) A plasmid harboring protospacer 4 target sequence and a WT PAM was subjected to cleavage by Cas9 programmed with tracrRNA(4-89):crRNA-sp4 duplex or in vitro-transcribed chimeric RNAs constructed by joining the 3' end of crRNA to the 5' end of tracrRNA with a GAAA tetraloop. Cleavage reactions were analyzed by restriction mapping with XmnI. Sequences of chimeric RNAs A and B are shown with DNA-targeting (underline), crRNA repeat-derived sequences (overlined), and tracrRNA-derived (dashed underlined) sequences. (FIG. 14B) Protospacer 4 DNA duplex cleavage reactions were performed as in FIG. 10B. (FIG. 14C) Five chimeric RNAs designed to target the GFP gene were used to program Cas9 to cleave a GFP gene-containing plasmid. Plasmid cleavage reactions were performed as in FIG. 12E, except that the plasmid DNA was restriction mapped with AvrII after Cas9 cleavage.

(FIG. 27A) A single chimeric RNA guides Cas9-catalyzed cleavage of cognate protospacer plasmid DNA (protospacer 1 and protospacer 2). The cleavage reactions were carried out in the presence of the XmnI restriction endonuclease to visualize the Cas9 cleavage products as two fragments (~1880 and ~800 bp). Fragment sizes in base pairs are indicated. (FIG. 27B) A single chimeric RNA guides Cas9-catalyzed cleavage of cognate protospacer oligonucleotide DNA (protospacer 1 and protospacer 2). Fragment sizes in nucleotides are indicated. (FIG. 27C) Schematic representations of the chimeric RNAs used in the experiment. Sequences of chimeric RNAs A and B are shown with the 5' protospacer DNA-targeting sequence of crRNA (underlined), the tracrRNA-binding sequence of crRNA (overlined) and tracrRNA-derived sequence (dashed underlined).

(FIG. 28A) Schematic representation of the GFP expression plasmid pCFJ127. The targeted portion of the GFP open reading frame is indicated with a black arrowhead. (FIG. 28B) Close-up of the sequence of the targeted region. Sequences targeted by the chimeric RNAs are shown with gray bars. PAM dinucleotides are boxed. A unique SalI restriction site is located 60 bp upstream of the target locus. (FIG. 28C) Left: Target DNA sequences are shown together with their adjacent PAM motifs. Right: Sequences of the chimeric guide RNAs. (FIG. 28D) pCFJ127 was cleaved by Cas9 programmed with chimeric RNAs GFP1-5, as indicated. The plasmid was additionally digested with SalI and the reactions were analyzed by electrophoresis on a 3% agarose gel and visualized by staining with SYBR Safe.

Conclusions

A DNA interference mechanism was identified, involving a dual-RNA structure that directs a Cas9 endonuclease to introduce site-specific double-stranded breaks in target DNA. The tracrRNA:crRNA-guided Cas9 protein makes use of distinct endonuclease domains (HNH and RuvC-like domains) to cleave the two strands in the target DNA. Target recognition by Cas9 requires both a seed sequence in the crRNA and a GG dinucleotide-containing PAM sequence adjacent to the crRNA-binding region in the DNA target. We further show that the Cas9 endonuclease can be programmed with guide RNA engineered as a single transcript to target and cleave any dsDNA sequence of interest. The system is efficient, versatile, and programmable by changing the DNA target-binding sequence in the guide chimeric RNA. Zinc-finger nucleases and transcription-activator-like effector nucleases have attracted considerable interest as artificial enzymes engineered to manipulate genomes (35-38). This represents alternative methodology based on RNA-programmed Cas9 that facilitates gene-targeting and genome-editing applications.

REFERENCES CITED

1. B. Wiedenheft, S. H. Sternberg, J. A. Doudna, Nature 482, 331 (2012).
2. D. Bhaya, M. Davison, R. Barrangou, Annu. Rev. Genet. 45, 273 (2011).
3. M. P. Terns, R. M. Terns, Curr. Opin. Microbiol. 14, 321 (2011).
4. E. Deltcheva et al., Nature 471, 602 (2011).
5. J. Carte, R. Wang, H. Li, R. M. Terns, M. P. Terns, Genes Dev. 22, 3489 (2008).
6. R. E. Haurwitz, M. Jinek, B. Wiedenheft, K. Zhou, J. A. Doudna, Science 329, 1355 (2010).
7. R. Wang, G. Preamplume, M. P. Terns, R. M. Terns, H. Li, Structure 19, 257 (2011).
8. E. M. Gesner, M. J. Schellenberg, E. L. Garside, M. M. George, A. M. Macmillan, Nat. Struct. Mol. Biol. 18, 688 (2011).
9. A. Hatoum-Aslan, I. Maniv, L. A. Marraffini, Proc. Natl. Acad. Sci. U.S.A. 108, 21218 (2011).
10. S. J. J. Brouns et al., Science 321, 960 (2008).
11. D. G. Sashital, M. Jinek, J. A. Doudna, Nat. Struct. Mol. Biol. 18, 680 (2011).
12. N. G. Lintner et al., J. Biol. Chem. 286, 21643 (2011).
13. E. Semenova et al., Proc. Natl. Acad. Sci. U.S.A. 108, 10098 (2011).
14. B. Wiedenheft et al., Proc. Natl. Acad. Sci. U.S.A. 108, 10092 (2011).
15. B. Wiedenheft et al., Nature 477, 486 (2011).
16. C. R. Hale et al., Cell 139, 945 (2009).
17. J. A. L. Howard, S. Delmas, I. Ivančić-Baće, E. L. Bolt, Biochem. J. 439, 85 (2011).
18. E. R. Westra et al., Mol. Cell 46, 595 (2012).
19. C. R. Hale et al., Mol. Cell 45, 292 (2012).
20. J. Zhang et al., Mol. Cell 45, 303 (2012).
21. K. S. Makarova et al., Nat. Rev. Microbiol. 9, 467 (2011).
22. K. S. Makarova, N. V. Grishin, S. A. Shabalina, Y. I. Wolf, E. V. Koonin, Biol. Direct 1, 7 (2006).
23. K. S. Makarova, L. Aravind, Y. I. Wolf, E. V. Koonin, Biol. Direct 6, 38 (2011).
24. S. Gottesman, Nature 471, 588 (2011).
25. R. Barrangou et al., Science 315, 1709 (2007).
26. J. E. Garneau et al., Nature 468, 67 (2010).
27. R. Sapranauskas et al., Nucleic Acids Res. 39, 9275 (2011).
28. G. K. Taylor, D. F. Heiter, S. Pietrokovski, B. L. Stoddard, Nucleic Acids Res. 39, 9705 (2011).
29. H. Deveau et al., J. Bacteriol. 190, 1390 (2008).
30. B. P. Lewis, C. B. Burge, D. P. Bartel, Cell 120, 15 (2005).
31. G. Hutvagner, M. J. Simard, Nat. Rev. Mol. Cell Biol. 9, 22 (2008).
32. F. J. M. Mojica, C. Díez-Villaseñor, J. Garcia-Martinez, C. Almendros, Microbiology 155, 733 (2009).
33. L. A. Marraffini, E. J. Sontheimer, Nature 463, 568 (2010).
34. D. G. Sashital, B. Wiedenheft, J. A. Doudna, Mol. Cell 46, 606 (2012).
35. M. Christian et al., Genetics 186, 757 (2010).
36. J. C. Miller et al., Nat. Biotechnol. 29, 143 (2011).
37. F. D. Urnov, E. J. Rebar, M. C. Holmes, H. S. Zhang, P. D. Gregory, Nat. Rev. Genet. 11, 636 (2010).
38. D. Carroll, Gene Ther. 15, 1463 (2008).
39. J. Sambrook, E. F. Fritsch, T. Maniatis, Molecular Cloning: A Laboratory Manual (Cold Spring Harbor Laboratory Press, Cold Spring Harbor, N.Y., ed. 2, 1989).
40. M. G. Caparon, J. R. Scott, Genetic manipulation of pathogenic streptococci. Methods Enzymol. 204, 556 (1991). doi:10.1016/0076-6879(91)04028-M Medline
41. C. Frøkjœr-Jensen et al., Single-copy insertion of transgenes in *Caenorhabditis elegans*. Nat. Genet. 40, 1375 (2008). doi:10.1038/ng.248 Medline
42. R. B. Denman, Using RNAFOLD to predict the activity of small catalytic RNAs. Biotechniques 15, 1090 (1993). Medline
43. I. L. Hofacker, P. F. Stadler, Memory efficient folding algorithms for circular RNA secondary structures. Bioinformatics 22, 1172 (2006). doi:10.1093/bioinformatics/btl023 Medline
44. K. Darty, A. Denise, Y. Ponty, VARNA: Interactive drawing and editing of the RNA secondary structure. Bioinformatics 25, 1974 (2009). doi:10.1093/bioinformatics/btp250 Medline Example 2: RNA-Programmed Genome Editing in Human Cells Data provided below demonstrate that Cas9 can be expressed and localized to the nucleus of human cells, and that it assembles with single-guide RNA ("sgRNA"; encompassing the features required for both Cas9 binding and DNA target site recognition) in a human cell. These complexes can generate double stranded breaks and stimulate non-homologous end joining (NHEJ) repair in genomic DNA at a site complementary to the sgRNA sequence, an activity that requires both Cas9 and the sgRNA. Extension of the RNA sequence at its 3' end enhances DNA targeting activity in living cells. Further, experiments using extracts from transfected cells show that sgRNA assembly into Cas9 is the limiting factor for Cas9-mediated DNA cleavage. These results demonstrate that RNA-programmed genome editing works in living cells and in vivo.

Materials and Methods

Plasmid Design and Construction

The sequence encoding *Streptococcus pyogenes* Cas9 (residues 1-1368) fused to an HA epitope (amino acid sequence DAYPYDVPDYASL (SEQ ID NO:274)), a nuclear localization signal (amino acid sequence PKKKRK-VEDPKKKRKVD (SEQ ID NO:275)) was codon optimized for human expression and synthesized by GeneArt. The DNA sequence is SEQ ID NO:276 and the protein sequence is SEQ ID NO:277. Ligation-independent cloning (LIC) was used to insert this sequence into a pcDNA3.1-derived GFP and mCherry LIC vectors (vectors 6D and 6B, respectively, obtained from the UC Berkeley MacroLab), resulting in a Cas9-HA-NLS-GFP and Cas9-HA-NLS-mCherry fusions expressed under the control of the CMV promoter. Guide sgRNAs were expressed using expression vector pSilencer 2.1-U6 puro (Life Technologies) and pSuper (Oligoengine). RNA expression constructs were generated by annealing complementary oligonucleotides to form the RNA-coding DNA sequence and ligating the annealed DNA fragment between the BamHI and HindIII sites in pSilencer 2.1-U6 puro and BglII and HindIII sites in pSuper.

Cell Culture Conditions and DNA Transfections

HEK293T cells were maintained in Dulbecco's modified eagle medium (DMEM) supplemented with 10% fetal bovine serum (FBS) in a 37° C. humidified incubator with 5% $CO_2$. Cells were transiently transfected with plasmid DNA using either X-tremeGENE DNA Transfection Reagent (Roche) or Turbofect Transfection Reagent (Thermo Scientific) with recommended protocols. Briefly, HEK293T cells were transfected at 60-80% confluency in 6-well plates using 0.5 µg of the Cas9 expression plasmid and 2.0 µg of the RNA expression plasmid. The transfection efficiencies were estimated to be 30-50% for Tubofect (FIG. 29E and FIGS. 37A-37B) and 80-90% for X-tremegene (FIG. 31B), based on the fraction of GFP-positive cells observed by fluorescence microscopy. 48 hours post transfection, cells were washed with phosphate buffered saline (PBS) and lysed by applying 250 µl lysis buffer (20 mM Hepes pH 7.5, 100 mM potassium chloride (KCl), 5 mM magnesium chloride ($MgCl_2$), 1 mM dithiothreitol (DTT), 5% glycerol, 0.1% Triton X-100, supplemented with Roche Protease Inhibitor cocktail) and then rocked for 10 min at 4° C. The resulting cell lysate was divided into aliquots for further analysis. Genomic DNA was isolated from 200 µl cell lysate using the DNeasy Blood and Tissue Kit (Qiagen) according to the manufacturer's protocol.

Western Blot Analysis of Cas9 Expression

HEK293T, transfected with the Cas9-HA-NLS-GFP expression plasmid, were harvested and lysed 48 hours post transfection as above. 5 ul of lysate were eletrophoresed on a 10% SDS polyacrylamide gel, blotter onto a PVDF membrane and probed with HRP-conjugated anti-HA antibody (Sigma, 1:1000 dilution in 1×PBS).

Surveyor Assay

The Surveyor assay was performed as previously described [10,12,13]. Briefly, the human clathrin light chain A (CLTA) locus was PCR amplified from 200 ng of genomic DNA using a high fidelity polymerase, Herculase II Fusion DNA Polymerase (Agilent Technologies) and forward primer 5'-GCAGCAGAAGAAGCCTTTGT-3' (SEQ ID NO: 1353) and reverse primer 5'-TTCCTCCTCTCCCTC-CTCTC-3' (SEQ ID NO: 1354). 300 ng of the 360 bp amplicon was then denatured by heating to 95° C. and slowly reannealed using a heat block to randomly rehybridize wild type and mutant DNA strands. Samples were then incubated with Cel-1 nuclease (Surveyor Kit, Transgenomic) for 1 hour at 42° C. Cel-1 recognizes and cleaves DNA helices containing mismatches (wild type:mutant hybridization). Cel-1 nuclease digestion products were separated on a 10% acrylamide gel and visualized by staining with SYBR Safe (Life Technologies). Quantification of cleavage bands was performed using ImageLab software (Bio-Rad). The percent cleavage was determined by dividing the average intensity of cleavage products (160-200 bps) by the sum of the intensities of the uncleaved PCR product (360 bp) and the cleavage product.

In Vitro Transcription

Guide RNA was in vitro transcribed using recombinant T7 RNA polymerase and a DNA template generated by annealing complementary synthetic oligonucleotides as previously described [14]. RNAs were purified by electrophoresis on 7M urea denaturing acrylamide gel, ethanol precipitated, and dissolved in DEPC-treated water.

Northern Blot Analysis

RNA was purified from HEK293T cells using the mirVana small-RNA isolation kit (Ambion). For each sample, 800 ng of RNA were separated on a 10% urea-PAGE gel after denaturation for 10 min at 70° C. in RNA loading buffer (0.5×TBE (pH7.5), 0.5 mg/ml bromophenol blue, 0.5 mg xylene cyanol and 47% formamide). After electrophoresis at 10 W in 0.5×TBE buffer until the bromophenol blue dye reached the bottom of the gel, samples were electroblotted onto a Nytran membrane at 20 volts for 1.5 hours in 0.5×TBE. The transferred RNAs were cross-linked onto the Nytran membrane in UV-Crosslinker (Strategene) and were pre-hybridized at 45° C. for 3 hours in a buffer containing 40% formamide, 5×SSC, 3× Dernhardt's (0.1% each of ficoll, polyvinylpyrollidone, and BSA) and 200 µg/ml Salmon sperm DNA. The pre-hybridized membranes were incubated overnight in the prehybridization buffer supplemented with 5'-$^{32}$P-labeled antisense DNA oligo probe at 1 million cpm/ml. After several washes in SSC buffer (final wash in 0.2×SCC), the membranes were imaged phosphorimaging.

In Vitro Cleavage Assay

Cell lysates were prepared as described above and incubated with CLTA-RFP donor plasmid [10]. Cleavage reactions were carried out in a total volume of 20 µl and contained 10 µl lysate, 2 µl of 5× cleavage buffer (100 mM HEPES pH 7.5, 500 mM KCl, 25 mM $MgCl_2$, 5 mM DTT, 25% glycerol) and 300 ng plasmid. Where indicated, reactions were supplemented with 10 pmol of in vitro transcribed CLTA1 sgRNA. Reactions were incubated at 37° C. for one hour and subsequently digested with 10 U of XhoI (NEB) for an additional 30 min at 37° C. The reactions were stopped by the addition of Proteinase K (Thermo Scientific) and incubated at 37° C. for 15 min. Cleavage products were analyzed by electrophoresis on a 1% agarose gel and stained with SYBR Safe. The presence of ~2230 and ~3100 bp fragments is indicative of Cas9-mediated cleavage.

Results

Figure 29B:
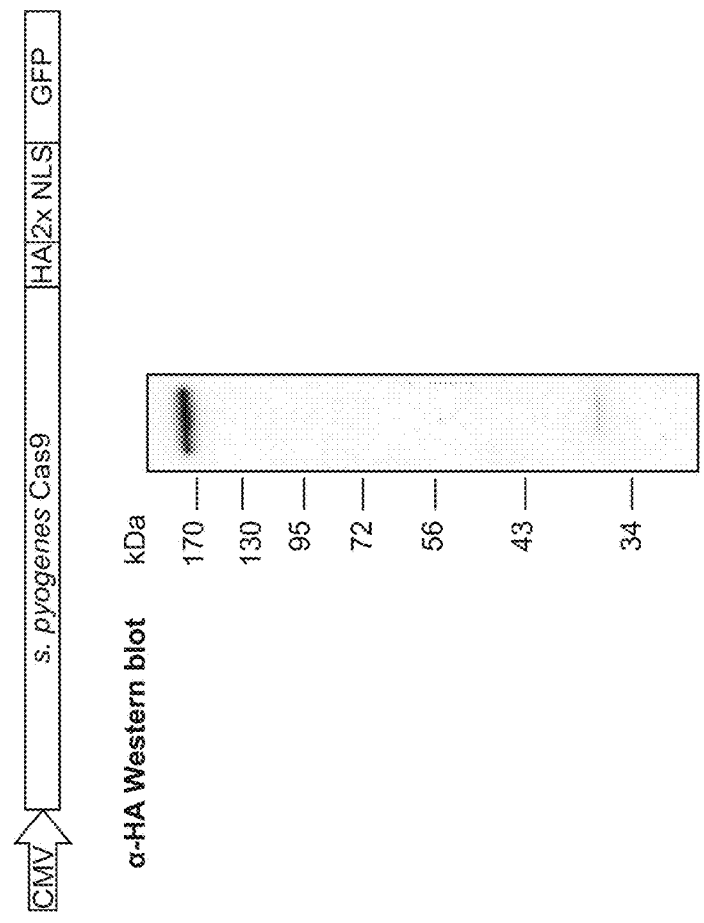
Figure 29D:
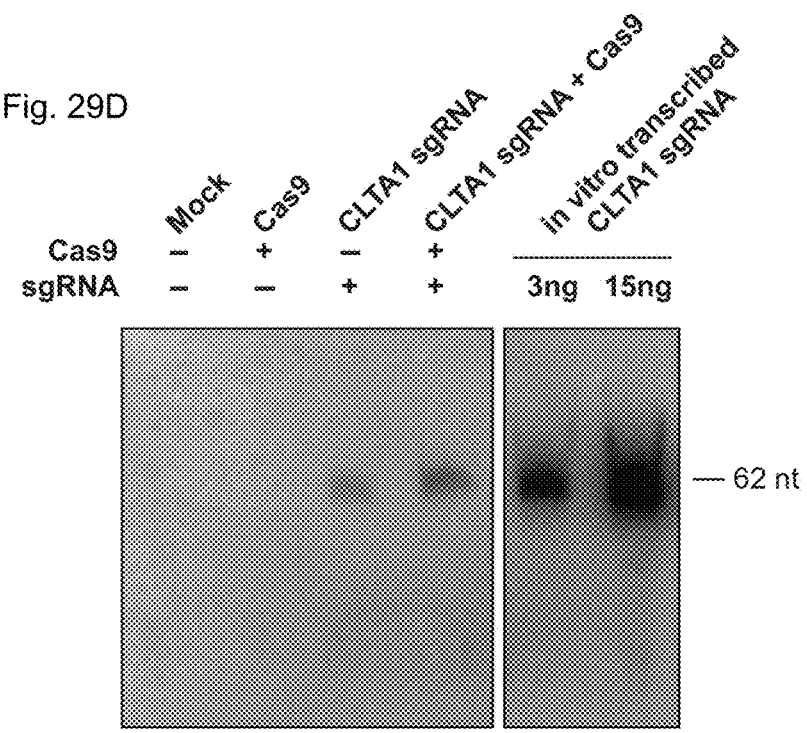

To test whether Cas9 could be programmed to cleave genomic DNA in living cells, Cas9 was co-expressed together with an sgRNA designed to target the human clathrin light chain (CLTA) gene. The CLTA genomic locus has previously been targeted and edited using ZFNs [10]. We first tested the expression of a human-codon-optimized version of the *Streptococcus pyogenes* Cas9 protein and sgRNA in human HEK293T cells. The 160 kDa Cas9 protein was expressed as a fusion protein bearing an HA epitope, a nuclear localization signal (NLS), and green fluorescent protein (GFP) attached to the C-terminus of Cas9 (FIG. 29A). Analysis of cells transfected with a vector encoding the GFP-fused Cas9 revealed abundant Cas9 expression and nuclear localization (FIG. 29B). Western blotting confirmed that the Cas9 protein is expressed largely intact in extracts from these cells (FIG. 29A). To program Cas9, we expressed sgRNA bearing a 5'-terminal 20-nucleotide sequence complementary to the target DNA sequence, and a 42-nucleotide 3'-terminal stem loop structure required for Cas9 binding (FIG. 29C). This 3'-terminal sequence corresponds to the minimal stem-loop structure that has previously been used to program Cas9 in vitro [8]. The expression of this sgRNA was driven by the human U6 (RNA polymerase III) promoter [11]. Northern blotting analysis of RNA extracted from cells transfected with the U6 promoter-driven sgRNA plasmid expression vector showed that the sgRNA is indeed expressed, and that their stability is enhanced by the presence of Cas9 (FIG. 29D).

FIG. 29A-29E demonstrates that co-expression of Cas9 and guide RNA in human cells generates double-strand DNA breaks at the target locus. (FIG. 29A) Top; schematic diagram of the Cas9-HA-NLS-GFP expression construct. Bottom; lysate from HEK293T cells transfected with the Cas9 expression plasmid was analyzed by Western blotting using an anti-HA antibody. (FIG. 29B) Fluorescence microscopy of HEK293T cells expressing Cas9-HA-NLS-GFP. (FIG. 29C) Design of a single-guide RNA (sgRNA, i.e., a single-molecule DNA-targeting RNA) targeting the human CLTA locus. Top; schematic diagram of the sgRNA target site in exon 7 of the human CLTA gene. The target sequence that hybridizes to the guide segment of CLTA1 sgRNA is indicated by "CLTA1 sgRNA." The GG di-nucleotide protospacer adjacent motif (PAM) is marked by an arrow. Black lines denote the DNA binding regions of the control ZFN protein. The translation stop codon of the CLTA open reading frame is marked with a dotted line for reference. Middle; schematic diagram of the sgRNA expression construct. The RNA is expressed under the control of the U6 Pol III promoter and a poly(T) tract that serves as a Pol III transcriptional terminator signal. Bottom; sgRNA-guided cleavage of target DNA by Cas9. The sgRNA consists of a 20-nt 5'-terminal guide segment followed by a 42-nt stem-loop structure required for Cas9 binding. Cas9-mediated cleavage of the two target DNA strands occurs upon unwinding of the target DNA and formation of a duplex between the guide segment of the sgRNA and the target DNA. This is dependent on the presence of a PAM motif (appropriate for the Cas9 being used, e.g., GG dinucleotide, see Example 1 above) downstream of the target sequence in the target DNA. Note that the target sequence is inverted relative to the upper diagram. (FIG. 29D) Northern blot analysis of sgRNA expression in HEK239T cells. (FIG. 29E) Surveyor nuclease assay of genomic DNA isolated from HEK293T cells expressing Cas9 and/or CLTA sgRNA. A ZFN construct previously used to target the CLTA locus [10] was used as a positive control for detecting DSB-induced DNA repair by non-homologous end joining.

Figure 29E:
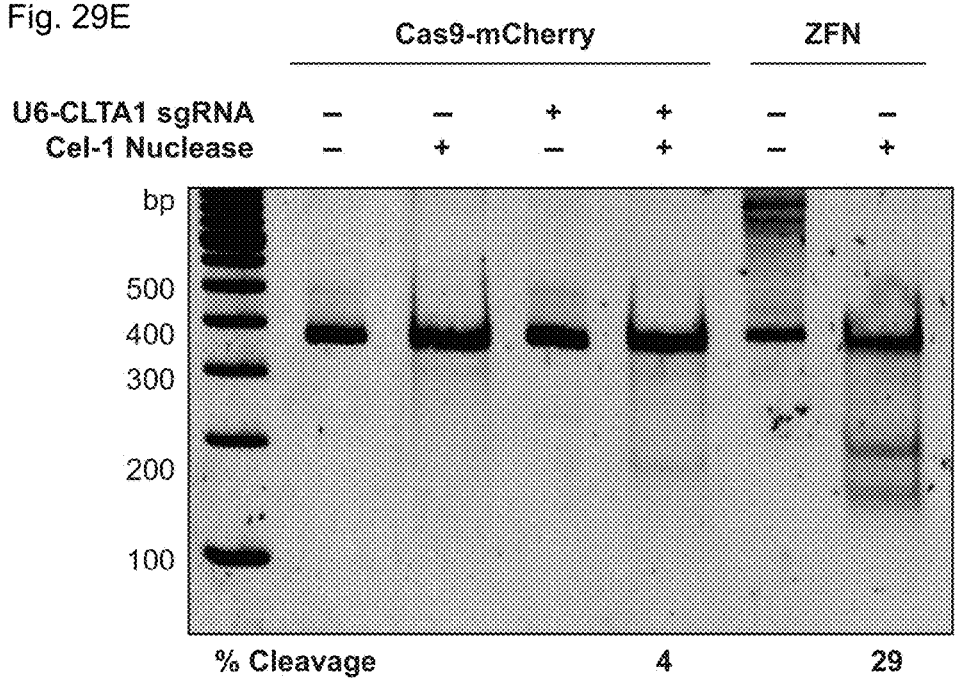

Next we investigated whether site-specific DSBs are generated in HEK293T cells transfected with Cas9-HA-NLS-mCherry and the CLTA1 sgRNA. To do this, we probed for minor insertions and deletions in the locus resulting from imperfect repair by DSB-induced NHEJ using the Surveyor nuclease assay [12]. The region of genomic DNA targeted by Cas9:sgRNA is amplified by PCR and the resulting products are denatured and reannealed. The rehybridized PCR products are incubated with the mismatch recognition endonuclease Cel-1 and resolved on an acrylamide gel to identify Cel-1 cleavage bands. As DNA repair by NHEJ is typically induced by a DSB, a positive signal in the Surveyor assay indicates that genomic DNA cleavage has occurred. Using this assay, we detected cleavage of the CLTA locus at a position targeted by the CLTA1 sgRNA (FIG. 29E). A pair of ZFNs that target a neighboring site in the CLTA locus provided a positive control in these experiments [10].

To determine if either Cas9 or sgRNA expression is a limiting factor in the observed genome editing reactions, lysates prepared from the transfected cells were incubated with plasmid DNA harboring a fragment of the CLTA gene targeted by the CLTA1 sgRNA. Plasmid DNA cleavage was not observed upon incubation with lysate prepared from cells transfected with the Cas9-HA-NLS-GFP expression vector alone, consistent with the Surveyor assay results. However, robust plasmid cleavage was detected when the lysate was supplemented with in vitro transcribed CLTA1 sgRNA (FIG. 30A). Furthermore, lysate prepared from cells transfected with both Cas9 and sgRNA expression vectors supported plasmid cleavage, while lysates from cells transfected with the sgRNA-encoding vector alone did not (FIG. 30A). These results suggest that a limiting factor for Cas9 function in human cells could be assembly with the sgRNA. We tested this possibility directly by analyzing plasmid cleavage in lysates from cells transfected as before in the presence and absence of added exogenous sgRNA. Notably, when exogenous sgRNA was added to lysate from cells transfected with both the Cas9 and sgRNA expression vectors, a substantial increase in DNA cleavage activity was observed (FIG. 30B). This result indicates that the limiting factor for Cas9 function in HEK293T cells is the expression of the sgRNA or its loading into Cas9.

FIG. 30A-30B demonstrates that cell lysates contain active Cas9:sgRNA and support site-specific DNA cleavage. (FIG. 30A) Lysates from cells transfected with the plasmid(s) indicated at left were incubated with plasmid DNA containing a PAM and the target sequence complementary to the CLTA1 sgRNA; where indicated, the reaction was supplemented with 10 pmol of in vitro transcribed CLTA1 sgRNA; secondary cleavage with XhoI generated fragments of ~2230 and ~3100 bp fragments indicative of Cas9-mediated cleavage. A control reaction using lysate from cells transfected with a ZFN expression construct shows fragments of slightly different size reflecting the offset of the ZFN target site relative to the CLTA1 target site. (FIG. 30B) Lysates from cells transfected with Cas9-GFP expression plasmid and, where indicated, the CLTA1 sgRNA expression plasmid, were incubated with target plasmid DNA as in FIG. 30A in the absence or presence of in vitro-transcribed CLTA1 sgRNA.

As a means of enhancing the Cas9:sgRNA assembly in living cells, we next tested the effect of extending the presumed Cas9-binding region of the guide RNA. Two new versions of the CLTA1 sgRNA were designed to include an additional six or twelve base pairs in the helix that mimics the base-pairing interactions between the crRNA and tracrRNA (FIG. 31A). Additionally, the 3'-end of the guide RNA was extended by five nucleotides based on the native sequence of the *S. pyogenes* tracrRNA [9]. Vectors encoding these 3' extended sgRNAs under the control of either the U6 or H1 Pol III promoters were transfected into cells along with the Cas9-HA-NLS-GFP expression vector and site-specific genome cleavage was tested using the Surveyor assay (FIG. 31B). The results confirmed that cleavage required both Cas9 and the CLTA1 sgRNA, but did not occur when either Cas9 or the sgRNA were expressed alone. Furthermore, we observed substantially increased frequencies of NHEJ, as detected by Cel-1 nuclease cleavage, while the frequency of NHEJ mutagenesis obtained with the control ZFN pair was largely unchanged.

FIG. 31A-31B demonstrates that 3' extension of sgRNA constructs enhances site-specific NHEJ-mediated mutagenesis. (FIG. 31A) The construct for CLTA1 sgRNA expression (top) was designed to generate transcripts containing the original Cas9-binding sequence (v1.0), or dsRNA duplexes extended by 4 base pairs (v2.1) or 10 base pairs (v2.2). (FIG. 31B) Surveyor nuclease assay of genomic DNA isolated from HEK293T cells expressing Cas9 and/or CLTA sgRNA v1.0, v2.1 or v2.2. A ZFN construct previously used to target the CLTA locus [10] was used as a positive control for detecting DSB-induced DNA repair by non-homologous end joining.

The results thus provide the framework for implementing Cas9 as a *facile* molecular tool for diverse genome editing applications. A powerful feature of this system is the potential to program Cas9 with multiple sgRNAs in the same cell, either to increase the efficiency of targeting at a single locus, or as a means of targeting several loci simultaneously. Such strategies would find broad application in genome-wide experiments and large-scale research efforts such as the development of multigenic disease models.

Example 3: The tracrRNA and Cas9 Families of Type II CRISPR-Cas Immunity Systems We searched for all putative type II CRISPR-Cas loci currently existing in publicly available bacterial genomes by screening for sequences homologous to Cas9, the hallmark protein of the type II system. We constructed a phylogenetic tree from a multiple sequence alignment of the identified Cas9 orthologues. The CRISPR repeat length and gene organization of cas operons of the associated type II systems were analyzed in the different Cas9 subclusters. A subclassification of type II loci was proposed and further divided into subgroups based on the selection of 75 representative Cas9 orthologues. We then predicted tracrRNA sequences mainly by retrieving CRISPR repeat sequences and screening for anti-repeats within or in the vicinity of the cas genes and CRISPR arrays of selected type II loci. Comparative analysis of sequences and predicted structures of chosen tracrRNA orthologues was performed. Finally, we determined the expression and processing profiles of tracrRNAs and crRNAs from five bacterial species.

Materials and Methods

Bacterial Strains and Culture Conditions

The following media were used to grow bacteria on plates: TSA (trypticase soy agar, Trypticase™ Soy Agar (TSA II) BD BBL, Becton Dickinson) supplemented with 3% sheep blood for *S. mutans* (UA159), and BHI (brain heart infusion, BD Bacto™ Brain Heart Infusion, Becton Dickinson) agar for *L. innocua* (Clip11262). When cultivated in liquid cultures, THY medium (Todd Hewitt Broth (THB, Bacto, Becton Dickinson) supplemented with 0.2% yeast extract (Servabacter®) was used for *S. mutans*, BHI broth for *L. innocua*, BHI liquid medium containing 1% vitamin-mix VX (Difco, Becton Dickinson) for *N. meningitidis* (A Z2491), MH (Mueller Hinton Broth, Oxoid) Broth including 1% vitamin-mix VX for *C. jejuni* (NCTC 11168; ATCC 700819) and TSB (Tryptic Soy Broth, BD BBL™ Trypticase™ Soy Broth) for *F. novicida* (U112). *S. mutans* was incubated at 37° C., 5% CO2 without shaking. Strains of *L. innocua*, *N. meningitidis* and *F. novicida* were grown aerobically at 37° C. with shaking. *C. jejuni* was grown at 37° C. in microaerophilic conditions using campygen (Oxoid) atmosphere. Bacterial cell growth was followed by measuring the optical density of cultures at 620 nm ($OD_{620}$ nm) at regular time intervals using a microplate reader (BioTek PowerWave™).

Sequencing of Bacterial Small RNA Libraries.

*C. jejuni* NCTC 11168 (ATCC 700819), *F. novicida* U112, *L. innocua* Clip11262, *N. meningitidis* A Z2491 and *S. mutans* UA159 were cultivated until mid-logarithmic growth phase and total RNA was extracted with TRIzol (Sigma-Aldrich). 10 μg of total RNA from each strain were treated with TURBO™ DNase (Ambion) to remove any residual genomic DNA. Ribosomal RNAs were removed by using the Ribo-Zero™ rRNA Removal Kits® for Gram-positive or Gram-negative bacteria (Epicentre) according to the manufacturer's instructions. Following purification with the RNA Clean & Concentrator™-5 kit (Zymo Research), the libraries were prepared using ScriptMiner™ Small RNA-Seq Library Preparation Kit (Multiplex, Illumina® compatible) following the manufacturer's instructions. RNAs were treated with the Tobacco Acid Pyrophosphatase (TAP) (Epicentre). Columns from RNA Clean & Concentrator™-5 (Zymo Research) were used for subsequent RNA purification and the Phusion® High-Fidelity DNA Polymerase (New England Biolabs) was used for PCR amplification. Specific userdefined barcodes were added to each library (RNA-Seq Barcode Primers (Illumina®-compatible) Epicentre) and the samples were sequenced at the Next Generation Sequencing (CSF NGS Unit; on the web at "csf." followed by "ac.at") facility of the Vienna Biocenter, Vienna, Austria (Illumina single end sequencing).

Analysis of tracrRNA and crRNA Sequencing Data

The RNA sequencing reads were split up using the illumina2bam tool and trimmed by (i) removal of Illumina adapter sequences (cutadapt 1.0) and (ii) removal of 15 nt at the 3' end to improve the quality of reads. After removal of reads shorter than 15 nt, the cDNA reads were aligned to their respective genome using Bowtie by allowing 2 mismatches: *C. jejuni* (GenBank: NC_002163), *F. novicida* (GenBank: NC_008601), *N. meningitidis* (GenBank: NC_003116), *L. innocua* (GenBank: NC_003212) and *S. mutans* (GenBank: NC_004350). Coverage of the reads was calculated at each nucleotide position separately for both DNA strands using BEDTools-Version-2.15.0. A normalized wiggle file containing coverage in read per million (rpm) was created and visualized using the Integrative Genomics Viewer (IGV) tool ("www." followed by "broadinstitute.org/igv/") (FIG. 36A-36F). Using SAMTools flagstat[80] the proportion of mapped reads was calculated on a total of mapped 9914184 reads for *C. jejuni*, 48205 reads for *F. novicida*, 13110087 reads for *N. meningitidis*, 161865 reads *L. innocua* and 1542239 reads for *S. mutans*. A file containing the number of reads starting (5') and ending (3') at each single nucleotide position was created and visualized in IGV. For each tracrRNA orthologue and crRNA, the total number of reads retrieved was calculated using SAMtools.

Cas9 Sequence Analysis, Multiple Sequence Alignment and Guide Tree Construction

Position-Specific Iterated (PSI)-BLAST program was used to retrieve homologues of the Cas9 family in the NCBI non redundant database. Sequences shorter than 800 amino acids were discarded. The BLASTClust program set up with a length coverage cutoff of 0.8 and a score coverage threshold (bit score divided by alignment length) of 0.8 was used to cluster the remaining sequences (FIG. 38A-38B). This procedure produced 78 clusters (48 of those were represented by one sequence only). One (or rarely a few representatives) were selected from each cluster and multiple alignment for these sequences was constructed using the MUSCLE program with default parameters, followed by a manual correction on the basis of local alignments obtained using PSI-BLAST and HHpred programs. A few more sequences were unalignable and also excluded from the final alignments. The confidently aligned blocks with 272 informative positions were used for maximum likelihood tree reconstruction using the FastTree program with the default parameters: JTT evolutionary model, discrete gamma model with 20 rate categories. The same program was used to calculate the bootstrap values.

FIG. 38A-38B depict sequences that were grouped according to the BLASTclust clustering program. Only sequences longer than 800 amino acids were selected for the BLASTclust analysis (see Materials and Methods). Representative strains harboring cas9 orthologue genes were used. Some sequences did not cluster, but were verified as Cas9 sequences due to the presence of conserved motifs and/or other cas genes in their immediate vicinity.

Analysis of CRISPR-Cas Loci

The CRISPR repeat sequences were retrieved from the CRISPRdb database or predicted using the CRISPRFinder tool (Grissa I et al., BMC Bioinformatics 2007; 8:172; Grissa I et al., Nucleic Acids Res 2007). The cas genes were identified using the BLASTp algorithm and/or verified with the KEGG database (on the web at "www." followed by kegg.jp/).

In Silico Prediction and Analysis of tracrRNA Orthologues

The putative antirepeats were identified using the Vector NTI® software (Invitrogen) by screening for additional, degenerated repeat sequences that did not belong to the repeat-spacer array on both strands of the respective genomes allowing up to 15 mismatches. The transcriptional promoters and rho-independent terminators were predicted using the BDGP Neural Network Promoter Prediction program ("www." followed by fruitfly.org/seq_tools/promoter.html) and the TransTermHP software, respectively. The multiple sequence alignments were performed using the MUSCLE program with default parameters. The alignments were analyzed for the presence of conserved structure motifs using the RNAalifold algorithm of the Vienna RNA package 2.0.

Results

Type II CRISPR-Cas Systems are Widespread in Bacteria.

In addition to the tracrRNA-encoding DNA and the repeat-spacer array, type II CRISPR-Cas loci are typically composed of three to four cas genes organized in an operon (FIG. 32A-32B). Cas9 is the signature protein characteristic for type II and is involved in the steps of expression and interference. Cas1 and Cas2 are core proteins that are shared by all CRISPR-Cas systems and are implicated in spacer acquisition. Csn2 and Cas4 are present in only a subset of type II systems and were suggested to play a role in adaptation. To retrieve a maximum number of type II CRISPR-Cas loci, containing tracrRNA, we first screened publicly available genomes for sequences homologous to already annotated Cas9 proteins. 235 Cas9 orthologues were identified in 203 bacterial species. A set of 75 diverse sequences representative of all retrieved Cas9 orthologues were selected for further analysis (FIGS. 32A-32B, FIGS. 38A-38B, and Materials and Methods).

FIG. 32A-32B depict (FIG. 32A) a phylogenetic tree of representative Cas9 sequences from various organisms as well as (FIG. 32B) representative Cas9 locus architecture. Bootstrap values calculated for each node are indicated. Same color branches represent selected subclusters of similar Cas9 orthologues. CRISPR repeat length in nucleotides, average Cas9 protein size in amino acids (aa) and consensus locus architecture are shown for every subcluster. *-gi|116628213 **-gi|116627542 †-gi|34557790 ‡gi|34557932. Type II-A is characterized by cas9-csx12, cas1, cas2, cas4. Type II-B is characterized by cas9, cas1, cas2 followed by a csn2 variant. Type II-C is characterized by a conserved cas9, cas1, cas2 operon (See also FIG. 38A-38B).

Next, we performed a multiple sequence alignment of the selected Cas9 orthologues. The comparative analysis revealed high diversities in amino acid composition and protein size. The Cas9 orthologues share only a few identical amino acids and all retrieved sequences have the same domain architecture with a central HNH endonuclease domain and splitted RuvC/RNaseH domain. The lengths of Cas9 proteins range from 984 (*Campylobacter jejuni*) to 1629 (*Francisella novicida*) amino acids with typical sizes of ~1100 or ~1400 amino acids. Due to the high diversity of Cas9 sequences, especially in the length of the inter-domain regions, we selected only well-aligned, informative positions of the prepared alignment to reconstruct a phylogenetic tree of the analyzed sequences (FIGS. 32A-32B and Materials and Methods). Cas9 orthologues grouped into three major, monophyletic clusters with some outlier sequences. The observed topology of the Cas9 tree is well in agreement with the current classification of type II loci, with previously defined type II-A and type II-B forming separate, monophyletic clusters. To further characterize the clusters, we examined in detail the cas operon compositions and CRISPR repeat sequences of all listed strains.

Cas9 Subclustering Reflects Diversity in Type II CRISPR-Cas Loci Architecture

A deeper analysis of selected type II loci revealed that the clustering of Cas9 orthologue sequences correlates with the diversity in CRISPR repeat length. For most of the type II CRISPR-Cas systems, the repeat length is 36 nucleotides (nt) with some variations for two of the Cas9 tree subclusters. In the type II-A cluster (FIG. 32A-32B) that comprises loci encoding the long Cas9 orthologue, previously named Csx12, the CRISPR repeats are 37 nt long. The small subcluster composed of sequences from bacteria belonging to the Bacteroidetes phylum (FIG. 32A-32B) is characterized by unusually long CRISPR repeats, up to 48 nt in size. Furthermore, we noticed that the subclustering of Cas9 sequences correlates with distinct cas operon architectures, as depicted in FIG. 32A-32B. The third major cluster (FIGS. 32A-32B) and the outlier loci (FIG. 32A-32B), consist mainly of the minimum operon composed of the cas9, cas1 and cas2 genes, with an exception of some incomplete loci that are discussed later. All other loci of the two first major clusters are associated with a fourth gene, mainly cas4, specific to type II-A or csn2-like, specific to type II-B (FIGS. 32A-32B). We identified genes encoding shorter variants of the Csn2 protein, Csn2a, within loci similar to type II-B *S. pyogenes* CRISPR01 and *S. thermophilus* CRISPR3 (FIGS. 32A-32B). The longer variant of Csn2, Csn2b, was found associated with loci similar to type II-B *S. thermophilus* CRISPR1 (FIGS. 32A-32B). Interestingly, we identified additional putative cas genes encoding proteins with no obvious sequence similarity to previously described Csn2 variants. One of those uncharacterized proteins is exclusively associated with type II-B loci of *Mycoplasma* species (FIGS. 32A-32B and FIGS. 33A-33E). Two others were found encoded in type II-B loci of *Staphylococcus* species (FIGS. 33A-33E). In all cases the cas operon architecture diversity is thus consistent with the subclustering of Cas9 sequences. These characteristics together with the general topology of the Cas9 tree divided into three major, distinct, monophyletic clusters, led us to propose a new, further division of the type II CRISPR-Cas system into three subtypes. Type II-A is associated with Csx12-like Cas9 and Cas4, type II-B is associated with Csn2-like and type II-C only contains the minimal set of the cas9, cas1 and cas2 genes, as depicted in FIG. 32A-32B.

FIG. 33A-33E depicts the architecture of type II CRISPR-Cas from selected bacterial species. The vertical bars group the loci that code for Cas9 orthologues belonging to the same tree subcluster (compare with FIG. 32A-32B). Horizontal black bar, leader sequence; black rectangles and diamonds, repeat-spacer array. Predicted anti-repeats are represented by arrows indicating the direction of putative tracrRNA orthologue transcription. Note that for the loci that were not verified experimentally, the CRISPR repeat-spacer array is considered here to be transcribed from the same strand as the cas operon. The transcription direction of the putative tracrRNA orthologue is indicated accordingly.

In Silico Predictions of Novel tracrRNA Orthologues

Type II loci selected earlier based on the 75 representative Cas9 orthologues were screened for the presence of putative tracrRNA orthologues. Our previous analysis performed on a restricted number of tracrRNA sequences revealed that neither the sequences of tracrRNAs nor their localization within the CRISPR-Cas loci seemed to be conserved. However, as mentioned above, tracrRNAs are also characterized by an anti-repeat sequence capable of base-pairing with each of the pre-crRNA repeats to form tracrRNA:precrRNA repeat duplexes that are cleaved by RNase III in the presence of Cas9. To predict novel tracrRNAs, we took advantage of this characteristic and used the following workflow: (i) screen for potential anti-repeats (sequence base-pairing with CRISPR repeats) within the CRISPR-Cas loci, (ii) select anti-repeats located in the intergenic regions, (iii) validate CRISPR anti-repeat:repeat base-pairing, and (iv) predict promoters and Rho-independent transcriptional terminators associated to the identified tracrRNAs.

To screen for putative anti-repeats, we retrieved repeat sequences from the CRISPRdb database or, when the information was not available, we predicted the repeat sequences using the CRISPRfinder software. In our previous study, we showed experimentally that the transcription direction of the repeat-spacer array compared to that of the cas operon varied among loci. Here RNA sequencing analysis confirmed this observation. In some of the analyzed loci, namely in *F. novicida, N. meningitidis* and *C. jejuni*, the repeat-spacer array is transcribed in the opposite direction of the cas operon (see paragraph 'Deep RNA sequencing validates expression of novel tracrRNA orthologues' and FIGS. 33A-33E and FIGS. 34A-34B) while in *S. pyogenes, S. mutans, S. thermophilus* and *L. innocua*, the array and the cas operon are transcribed in the same direction. These are the only type II repeat-spacer array expression data available to date. To predict the transcription direction of other repeat-spacer arrays, we considered the previous observation according to which the last repeats of the arrays are usually mutated. This remark is in agreement with the current spacer acquisition model, in which typically the first repeat of the array is duplicated upon insertion of a spacer sequence during the adaptation phase. For 37 repeat spacer arrays, we were able to identify the mutated repeat at the putative end of the arrays. We observed that the predicted orientation of transcription for the *N. meningitidis* and *C. jejuni* repeat-spacer array would be opposite to the orientation determined experimentally (RNA sequencing and Northern blot analysis). As the predicted orientation is not consistent within the clusters and as in most of the cases we could detect potential promoters on both ends of the arrays, we considered transcription of the repeat-spacer arrays to be in the same direction as transcription of the cas operon, if not validated otherwise.

FIG. 34A-34B depicts tracrRNA and pre-crRNA co-processing in selected type II CRISPR Cas systems. CRISPR loci architectures with verified positions and directions of tracrRNA and pre-crRNA transcription are shown. Top sequences, pre-crRNA repeats; bottom sequences, tracrRNA sequences base-pairing with crRNA repeats. Putative RNA processing sites as revealed by RNA sequencing are indicated with arrowheads. For each locus, arrowhead sizes represent relative amounts of the retrieved 5' and 3' ends (see also FIG. 37A-37O).

FIG. 37A-37O lists all tracrRNA orthologues and mature crRNAs retrieved by sequencing for the bacterial species studied, including coordinates (region of interest) and corresponding cDNA sequences (5' to 3'). The arrows represent the transcriptional direction (strand). Number of cDNA reads (calculated using SAMtools), coverage numbers (percentage of mapped reads) and predominant ends associated with each transcript are indicated. Numbers of reads starting or stopping at each nucleotide position around the 5' and 3' ends of each transcript are displayed. The sizes of each crRNA mature forms are indicated. The number allocated to each crRNA species corresponds to the spacer sequence position in the pre-crRNA, according to the CRISPRdb. The number allocated to each tracrRNA species corresponds to different forms of the same transcript.

We then screened the selected CRISPR-Cas loci including sequences located 1 kb upstream and downstream on both strands for possible repeat sequences that did not belong to the repeat-spacer array, allowing up to 15 mismatches. On average, we found one to three degenerated repeat sequences per locus that would correspond to anti-repeats of tracrRNA orthologues and selected the sequences located within the intergenic regions. The putative anti-repeats were found in four typical localizations: upstream of the cas9 gene, in the region between cas9 and cas1, and upstream or downstream of the repeat-spacer array (FIG. 33A-33E). For every retrieved sequence, we validated the extent of base-pairing formed between the repeat and anti-repeat (FIG. 44A-44C) by predicting the possible RNA:RNA interaction and focusing especially on candidates with longer and perfect complementarity region forming an optimal double-stranded structure for RNase III processing. To predict promoters and transcriptional terminators flanking the anti-repeat, we set the putative transcription start and termination sites to be included within a region located maximally 200 nt upstream and 100 nt downstream of the anti-repeat sequence, respectively, based on our previous observations[26]. As mentioned above, experimental information on the transcriptional direction of most repeat-spacer arrays of type II systems is lacking. The in silico promoter prediction algorithms often give false positive results and point to putative promoters that would lead to the transcription of repeat-spacer arrays from both strands. In some cases we could not predict transcriptional terminators, even though the tracrRNA orthologue expression could be validated experimentally, as exemplified by the *C. jejuni* locus (see paragraph 'Deep RNA sequencing validates expression of novel tracrRNA orthologues'). We suggest to consider promoter and transcriptional terminator predictions only as a supportive, but not essential, step of the guideline described above.

FIG. 44A-44C depicts predicted pre-crRNA repeat:tracrRNA anti-repeat basepairing in selected bacterial species. [b]The CRISPR loci belong to the type II (Nmeni/CASS4) CRISPR-Cas system. Nomenclature is according to the CRISPR database (CRISPRdb). Note that S. thermophilus LMD-9 and W. succinogenes contain two type II loci. [c]Upper sequence, pre-crRNA repeat consensus sequence (5' to 3'); lower sequence, tracrRNA homologue sequence annealing to the repeat (anti-repeat; 3' to 5'). Note that the repeat sequence given is based on the assumption that the CRISPR repeat-spacer array is transcribed from the same strand as the cas operon. For the sequences that were validated experimentally in this study, RNA sequencing data were taken into account to determine the base-pairing. See FIG. 33A-33E. [d]Two possible anti-repeats were identified in the F. tularensis subsp. novicida, W. succinogenes and gamma proteobacterium HTCC5015 type II-A loci. Upper sequence pairing, anti-repeat within the putative leader sequence; lower sequence pairing, anti-repeat downstream of the repeat spacer array. See FIG. 33A-33E. [e]Two possible anti-repeats were identified in the S. wadsworthensis type II-A locus. Upper sequence pairing, anti-repeat; lower sequence pairing, anti-repeat within the putative leader sequence See FIG. 33A-33E. [f]Two possible anti-repeats were identified in the L. gasseri type II-B locus. Upper sequence pairing, anti-repeat upstream of cas9; lower sequence pairing, anti-repeat between the cas9 and cas1 genes. See FIG. 33A-33E. [g]Two possible anti-repeats were identified in the C. jejuni type II-C loci. Upper sequence pairing, anti-repeat upstream of cas9; lower sequence pairing, anti-repeat downstream of the repeat-spacer array. See FIG. 33A-33E. [h]Two possible anti-repeats were identified in the R. rubrum type II-C locus. Upper sequence pairing, antirepeat downstream of the repeat-spacer array; lower sequence pairing, anti-repeat upstream of cas1. See FIG. 33A-33E.

A Plethora of tracrRNA Orthologues

We predicted putative tracrRNA orthologues for 56 of the 75 loci selected earlier. The results of predictions are depicted in FIG. 33A-33E. As already mentioned, the direction of tracrRNA transcription indicated in this Figure is hypothetical and based on the indicated direction of repeat-spacer array transcription. As previously stated, sequences encoding putative tracrRNA orthologues were identified upstream, within and downstream of the cas operon, as well as downstream of the repeat spacer arrays, including the putative leader sequences, commonly found in type II-A loci (FIG. 33A-33E). However, we observed that anti-repeats of similar localization within CRISPR-Cas loci can be transcribed in different directions (as observed when comparing e.g. Lactobacillus rhamnosus and Eubacterium rectale or Mycoplasma mobile and S. pyogenes or N. meningitidis) (FIG. 33A-33E). Notably, loci grouped within a same subcluster of the Cas9 guide tree share a common architecture with respect to the position of the tracrRNA-encoding gene. We identified anti-repeats around the repeat-spacer array in type II-A loci, and mostly upstream of the cas9 gene in types II-B and II-C with several notable exceptions for the putative tracrRNA located between cas9 and call in three distinct subclusters of type II-B.

Some Type II CRISPR-Cas Loci have Defective Repeat-Spacer Arrays and/or tracrRNA Orthologues For six type II loci (Fusobacterium nucleatum, Aminomonas paucivorans, Helicobacter mustelae, Azospirillum sp., Prevotella ruminicola and Akkermansia muciniphila), we identified potential anti-repeats with weak base-pairing to the repeat sequence or located within the open reading frames. Notably, in these loci, a weak anti-repeat within the open reading frame of the gene encoding a putative ATPase in A. paucivorans, a strong anti-repeat within the first 100 nt of the cas9 gene in Azospirillum sp. B510 and a strong anti-repeat overlapping with both cas9 and cas1 in A. muciniphila were identified (FIG. 33A-33E). For twelve additional loci (Peptoniphilus duerdenii, Coprococcus catus, Acidaminococcus intestini, Catenibacterium mitsuokai, Staphylococcus pseudintermedius, Ilyobacter polytropus, Elusimicrobium minutum, Bacteroides fragilis, Acidothermus cellulolyticus, Corynebacterium diphteriae, Bifidobacterium longum and Bifidobacterium dentium), we could not detect any putative anti-repeat. There is no available information on pre-crRNA expression and processing in these CRISPR-Cas loci. Thus, the functionality of type II systems in the absence of a clearly defined tracrRNA orthologue remains to be addressed. For seven analyzed loci we could not identify any repeat spacer array (Parasutterella excrementihominis, Bacillus cereus, Ruminococcus albus, Rhodopseudomonas palustris, Nitrobacter hamburgensis, Bradyrhizobium sp. and Prevotella micans) (FIGS. 33A-33E) and in three of those (Bradyrhizobium sp. BTAi1, N. hamburgensis and B. cereus) we detected cas9 as a single gene with no other cas genes in the vicinity. For these three loci, we failed to predict any small RNA sequence upstream or downstream of the cas9 gene. In the case of R. albus and P. excrementihominis, the genomic contig containing cas9 is too short to allow prediction of the repeat spacer array.

Deep RNA Sequencing Validates Expression of Novel tracrRNA Orthologues

To verify the in silico tracrRNA predictions and determine tracrRNA:pre-crRNA coprocessing patterns, RNAs from selected Gram-positive (S. mutans and L. innocua) and Gram-negative (N. meningitidis, C. jejuni and F. novicida) bacteria were analyzed by deep sequencing. Sequences of tracrRNA orthologues and processed crRNAs were retrieved (FIGS. 36A-36F and FIGS. 37A-37O). Consistent with previously published differential tracrRNA sequencing data in S. pyogenes[26], tracrRNA orthologues were highly represented in the libraries, ranging from 0.08 to 6.2% of total mapped reads. Processed tracrRNAs were also more abundant than primary transcripts, ranging from 66% to more than 95% of the total amount of tracrRNA reads (FIGS. 36A-36F and FIGS. 37A-37O).

FIGS. 36A-36F depict the expression of bacterial tracrRNA orthologues and crRNAs revealed by deep RNA sequencing. Expression profiles of tracrRNA orthologues and crRNAs of selected bacterial strains are represented along the corresponding genomes by bar charts (Images captured from the Integrative Genomics Viewer (IGV) tool). Campylobacter jejuni (GenBank: NC_002163), Francisella novicida (GenBank: NC_008601), Neisseria meningitidis (GenBank: NC_003116), Listeria innocua (GenBank: NC_003212) and Streptococcus mutans (GenBank: NC_004350). Genomic coordinates are given. [a]Sequence coverage calculated using BEDTools-Version-2.15.0 (Scale given in reads per million). [b]Distribution of reads starting (5') and ending (3') at each nucleotide position are indicated (Scale given in numbers of reads). Upper panels correspond to transcripts from the positive strand and lower panels correspond to transcripts from the negative strand. The negative coverage values and peaks presented below the axes indicate transcription from the negative strand of the genome. Predominant 5'- and 3'-ends of the reads are plotted for all RNAs. Note that given the low quality of L. innocua form of ~110 nt and a putative longer transcript of ~170 nt represented by a very low amount of reads and detected previously as a weak band by Northern blot analysis.

TABLE 2

Selected tracrRNA orthologues

| Strains[a] | Transcript | First read | 5'-end[b] RNA-seq Most prominent | Predicted | 3'-end[c] | Length (nt) |
|---|---|---|---|---|---|---|
| S. pyogenes | primary | — | 854 546 | — | 854 376 | 171 |
| SF370 | primary | — | <u>854 464</u> | — | | 89 |
| | processed | — | 854 450 | — | | ~75 |
| C. jejuni | primary | 1 455 497 | 1 455 502 | <u>1 455 497</u> | 1 455 570 | ~75 |
| NCTC 11168 | processed | — | 1 455 509 | — | | ~60 |
| L. innocue | primary | <u>2 774 774</u> | <u>2 774 774</u> | 2 774 773 | 2 774 863 | ~90 |
| Clip11262 | processed | — | 2 774 788 | — | | ~75 |
| S. mutans | primary | <u>1 335 040</u> | <u>1 335 040</u> | 1 355 039 | 1 335 141 | ~100 |
| UA159 | processed | — | 1 335 054 | — | | ~85 |
| | | | 1 335 062 | | | ~80 |
| N. meningitidis | primary | 614 158 | 614 162 | 614 154 | 614 333 | ~175 |
| A Z2491 | primary | <u>614 223</u> | 614 225 | <u>614 223</u> | | ~110 |
| | processed | — | 614 240 | — | | ~90 |
| F. novicida | primary | 817 144 | — | 817 145 | 817 065 | ~80 |
| U112 | | | | <u>817 154</u> | | |
| | processed | — | 817 138 | — | | ~75 |
| | | | 817 128 | | | ~85 |
| S. thermophilus | primary | — | — | 1 384 330 | 1 384 425 | ~95 |
| LMD-8 | primary | — | — | <u>646 654</u> | 646 762 | ~110 |
| P. multocida | primary | — | — | <u>1 327 287</u> | 1 327 396 | ~110 |
| Pm70 | | | | | | |
| M. mobile | primary | — | — | <u>49470</u> | 49 361 | ~110 |
| 163K | | | | | | |

[a]tracrRNA orthologues of S. thermophilus, P. multocida and M. mobile were predicted in silico.
[b]RNA-seq, revealed by RNA sequencing (Table S3); first read, first 5'-end position retrieved by sequencing; most prominent, abundant 5'-end according to RNA-seq data; predicted, in silico prediction of transcription start site; underlined, 5'-end chosen for the primary tracrRNA to be aligned.
[c]Estimated 3' end according to RNA-seq data and transcriptional terminator prediction.

cDNA library, the reads are shortened for crRNAs, and an accumulation of the reads at the 3' end of tracrRNA is observed, presumably due to RNA degradation.

To assess the 5' ends of tracrRNA primary transcripts, we analyzed the abundance of all 5' end reads of tracrRNA and retrieved the most prominent reads upstream or in the vicinity of the 5' end of the predicted anti-repeat sequence. The 5' ends of tracrRNA orthologues were further confirmed using the promoter prediction algorithm. The identified 5' ends of tracrRNAs from S. mutans, L. innocua and N. meningitidis correlated with both in silico predictions and Northern blot analysis of tracrRNA expression[26]. The most prominent 5' end of C. jejuni tracrRNA was identified in the middle of the anti-repeat sequence. Five nucleotides upstream, an additional putative 5' end correlating with the in silico prediction and providing longer sequence of interaction with the CRISPR repeat sequence was detected. We retrieved relatively low amount of reads from the F. novicida library that corresponded almost exclusively to processed transcripts. Analysis of the very small amount of reads of primary transcripts provided a 5' end that corresponded to the strong in silico promoter predictions. Northern blot probing of F. novicida tracrRNA further confirmed the validity of the predictions showing the low abundance of transcripts of around 90 nt in length. The results are listed in Table 2. For all examined species, except N. meningitidis, primary tracrRNA transcripts were identified as single small RNA species of 75 to 100 nt in length. In the case of N. meningitidis, we found a predominant primary tracrRNA tracrRNA and Pre-crRNA Co-Processing Sites Lie in the Anti-Repeat:Repeat Region.

We examined the processed tracrRNA transcripts by analyzing abundant tracrRNA 5' ends within the predicted anti-repeat sequence and abundant mature crRNA 3' ends (FIGS. 34A-34B and FIGS. 45A-45B). In all species, we identified the prominent 5' ends of tracrRNA orthologues that could result from co-processing of the tracrRNA:pre-crRNA repeat duplexes by RNase III. We also identified the processed 5'-ends of crRNAs that most probably result from a second maturation event by putative trimming, consistently with previous observations. Noteworthy, in the closely related RNA pairs of S. pyogenes, S. mutans and L. innocua, we observed the same processing site around the G:C basepair in the middle of the anti-repeat sequence. In both S. mutans and L. innocua, we detected additional prominent tracrRNA 5' ends and crRNA 3' ends that could suggest further trimming of the tracrRNA:crRNA duplex, with 3'-end of crRNA being shortened additionally to the already mentioned 5'-end trimming, following the RNase III-catalyzed first processing event. Similarly, in C. jejuni we found only a small amount of crRNA 3' ends that would fit to the RNase III processing patterns and retrieved the corresponding 5' ends of processed tracrRNA. Thus, the putative trimming of tracrRNA:crRNA duplexes after initial cleavage by RNase III would result in a shorter repeat-derived part in mature crRNAs, producing shorter tracrRNA:crRNA duplexes stabilized by a triple G:C base-pairing for interaction with the endonuclease Cas9 and subsequent cleavage of target DNAs. The N. meningitidis RNA duplex seems to be processed at two primary sites further to the 3' end of the CRISPR repeat, resulting in a long repeat-derived part in mature crRNA and stable RNA:RNA interaction despite the central bulge within the duplex. Interestingly, the tracrRNA: pre-crRNA duplex of *F. novicida* seems to be cleaved within the region of low complementarity and some of the retrieved abundant 5' ends of tracrRNA suggest its further trimming without concomitant trimming of crRNA. Differences in primary transcript sizes and in the location of processing sites result in various lengths of processed tracrRNAs ranging from ~65 to 85 nt. The coordinates and sizes of the prominent processed tracrRNA transcripts are shown in Table 2 and FIG. 37A-37O. The observed processing patterns of tracrRNA and crRNA are well in agreement with the previously proposed model of two maturation events. The putative further trimming of some of the tracrRNA 5'-ends and crRNA 3'-ends could stem from the second maturation event or alternatively, be an artifact of the cDNA library preparation or RNA sequencing. The nature of these processings remains to be investigated further.

Sequences of tracrRNA Orthologues are Highly Diverse

Sequences similarities of selected tracrRNA orthologues were also determined We performed multiple sequence alignments of primary tracrRNA transcripts of *S. pyogenes* (89 nt form only), *S. mutans*, *L. innocua* and *N. meningitidis* (110 nt form only), *S. thermophilus*, *P. multocida* and *M. mobile* (Table 2, FIG. 35). We observed high diversity in tracrRNA sequences but significant conservation of sequences from closely related CRISPR-Cas loci. tracrRNAs from *L. innocua, S. pyogenes, S. mutans* and *S. thermophiles* share on average 77% identity and tracrRNAs from *N. meningitidis* and *P. multocida* share 82% identity according to pairwise alignments. The average identity of the analyzed tracrRNA sequences is 56%, comparable to the identity of random RNA sequences. This observation further confirms that the prediction of tracrRNA orthologues based on sequence similarity can be performed only in the case of closely related loci. We also sought for possible tracrRNA structure conservation but could not find any significant similarity except one co-variation and conserved transcriptional terminator structure (FIG. 35).

FIG. 35 depicts sequence diversity of tracrRNA orthologues. tracrRNA sequence multiple alignment. *S. thermophilus* and *S. thermophilus*2, tracrRNA associated with SEQ ID NO:41 and SEQ ID NO:40 Cas9 orthologues, accordingly. Black, highly conserved; dark grey, conserved; light grey, weakly conserved. Predicted consensus structure is depicted on the top of the alignment. Arrows indicate the nucleotide covariations. *S. pyogenes* SF370, *S. mutans* UA159, *L. innocua* Clip11262, *C. jejuni* NCTC 11168, *F. novicida* U112 and *N. meningitidis* A Z2491 tracrRNAs were validated by RNA sequencing and Northern blot analysis. *S. thermophiles* LMD-9 tracrRNA was validated by Northern blot analysis. *P. multocida* Pm70 tracrRNA was predicted from high similarity of the CRISPR-Cas locus with that of *N. meningitidis* A Z2491. *M. mobile* 163K tracrRNA was predicted in silico from strong predictions of transcriptional promoter and terminator.

Example 4: Repurposing CRISPR as an RNA-Guided Platform for Sequence-Specific Control of Gene Expression Targeted gene regulation on a genome-wide scale is a powerful strategy for interrogating, perturbing and engineering cellular systems. The inventors have developed a new method for controlling gene expression, based on Cas9, an RNA-guided DNA endonuclease from a Type II CRISPR system. This example demonstrates that a catalytically dead Cas9, lacking endonuclease activity, when co-expressed with a guide RNA, generates a DNA recognition complex that can specifically interfere with transcriptional elongation, RNA polymerase binding, or transcription factor binding. This system, called CRISPR interference (CRISPRi), can efficiently repress expression of targeted genes in *Escherichia coli* with no detectable off-target effects. CRISPRi can be used to repress multiple target genes simultaneously, and its effects are reversible. In addition, the system can be adapted for gene repression in mammalian cells. This RNA-guided DNA recognition platform provides a simple approach for selectively perturbing gene expression on a genome-wide scale.

Materials and Methods

Strains and Media

The *Escherichia coli* K-12 strain MG1655 was used as the host strain for the in vivo fluorescence measurements. An *E. coli* MG1655-derived strain that endogenously expresses a variant of RNAP with a 3×-FLAG epitope tag attached to the C-terminal end of the RpoC subunit was used for all sequencing experiments. EZ rich defined media (EZ-RDM, Teknoka) was used as the growth media for in vivo fluorescence assays. Genetic transformation and verification of transformation were done using standard protocols, using AmpR, CmR, or KanR genes as selectable markers.

Plasmid Construction and *E. coli* Genome Cloning

The Cas9 and dCas9 genes were cloned from the previous described vector pMJ806 and pMJ841, respectively. The genes were PCR amplified and inserted into a vector containing an anhydrotetracycline (aTc)-inducible promoter PLtetO-1, a chloramphenicol selectable marker and a p15A replication origin. The sgRNA template was cloned into a vector containing a minimal synthetic promoter (J23119) with an annotated transcription start site, an ampicillin selectable marker and a ColE1 replication origin. Inverse PCR was used to generate sgRNA cassettes with new 20-bp complementary regions. To insert fluorescent reporter genes into *E. coli* genomes, the fluorescence gene was first cloned onto an entry vector, which was then PCR amplified to generate linearized DNA fragments that contained nsfA 5'/3' UTR sequences, the fluorescent gene and a KanR selectable marker. The *E. coli* MG1655 strain was transformed with a temperature-sensitive plasmid pKD46 that contained λ-Red recombination proteins (Exo, Beta and Gama). Cell cultures were grown at 30° C. to an OD (600 nm) of ~0.5, and 0.2% arabinose was added to induce expression of the λ-Red recombination proteins for 1 h. The cells were harvested at 4° C., and used for transformation of the linearized DNA fragments by electroporation. Cells that contain correct genome insertions were selected by using 50 μg/mL Kanamycin.

Flow Cytometry and Analysis

Strains were cultivated in EZ-RDM containing 100 μg/mL carbenicillin and 34 μg/mL chloramphenicol in 2 mL 96-well deep well plates (Costar 3960) overnight at 37 □C and 1200 r.p.m. One-μL of this overnight culture was then added to 249 μL of fresh EZ-RDM with the same antibiotic concentrations with 2 μM aTc supplemented to induce production of the dCas9 protein. When cells were grown to mid-log phase (~4 h), the levels of fluorescence protein were determined using the LSRII flow cytometer (BD Biosciences) equipped with a high-throughput sampler. Cells were sampled with a low flow rate until at least 20,000 cells had been collected. Data were analyzed using FCS Express (De Novo Software) by gating on a polygonal region containing 60% cell population in the forward scatter-side scatter plot. For each experiment, triplicate cultures were measured, and their standard deviation was indicated as the error bar.

B-Galactosidase Assay

To perform β-galactosidase assay, 1 µL of overnight culture prepared as above was added to 249 µL of fresh EZ-RDM with the same antibiotic concentrations with 2 µM aTc, with or without 1 mM Isopropyl β-D-1-thiogalactopyranoside (IPTG). Cells were grown to mid-log phase. The LacZ activity of 100 uL of this culture was measured using the yeast β-galactosidase assay kit (Pierce) following the instructions.

Extraction and Purification of Total RNA

For each sample, a monoclonal culture of E. coli was grown at 37° C. from an OD (600 nm) 0.1 in 500 mL of EZ-RDM to early log-phase (OD 0.45±0.05), at which point the cells were harvested by filtration over 0.22 µm nitrocellulose filters (GE) and frozen in liquid nitrogen to simultaneously halt all transcriptional progress. Frozen cells (100 µg) were pulverized on a Qiagen TissueLyser II mixer mill 6 times at 15 Hz for 3 min in the presence of 500 µL frozen lysis buffer (20 mM Tris pH 8, 0.4% Triton X-100, 0.1% NP-40, 100 mM $NH_4Cl$, 50 U/mL SUPERase.In (Ambion) and 1× protease inhibitor cocktail (Complete, EDTA-free, Roche), supplemented with 10 mM $MnCl_2$ and 15 µM Tagetin transcriptional inhibitor (Epicentre).

The lysate was resuspended on ice by pipetting. RQ1 DNase I (110 U total, Promega) was added and incubated for 20 min on ice. The reaction was quenched with EDTA (25 mM final) and the lysate clarified at 4° C. by centrifugation at 20,000 g for 10 min. The lysate was loaded onto a PD MiniTrap G-25 column (GE Healthcare) and eluted with lysis buffer supplemented with 1 mM EDTA.

Total mRNA Purification

Total RNA was purified from the clarified lysate using the miRNeasy kit (Qiagen). 1 µg of RNA in 20 µL of 10 mM Tris pH 7 was mixed with an equal volume of 2× alkaline fragmentation solution (2 mM EDTA, 10 mM $Na_2CO_3$, 90 mM $NaHCO_3$, pH 9.3) and incubated for ~25 min at 95° C. to generate fragments ranging from 30-100 nt. The fragmentation reaction was stopped by adding 0.56 mL of ice-cold precipitation solution (300 mM NaOAc pH 5.5 plus GlycoBlue (Ambion)), and the RNA was purified by a standard isopropanol precipitation. The fragmented mRNA was then dephosphorylated in a 50 µL reaction with 25 U T4 PNK (NEB) in 1×PNK buffer (without ATP) plus 0.5 U SUPERase.In, and precipitated with GlycoBlue via standard isopropanol precipitation methods.

Nascent RNA Purification

For nascent RNA purification, the clarified lysate was added to 0.5 mL anti-FLAG M2 affinity gel (Sigma Aldrich) as described previously. The affinity gel was washed twice with lysis buffer supplemented with 1 mM EDTA before incubation with the clarified lysate at 4° C. for 2.5 h with nutation. The immunoprecipitation was washed 4×10 ml with lysis buffer supplemented with 300 mM KCl, and bound RNAP was eluted twice with lysis buffer supplemented with 1 mM EDTA and 2 mg/mL 3×-FLAG peptide (Sigma Aldrich). Nascent RNA was purified from the eluate using the miRNeasy kit (Qiagen) and converted to DNA using a previously established library generation protocol.

DNA Library Preparation and DNA Sequencing

The DNA library was sequencing on an Illumina HiSeq 2000. Reads were processed using the HTSeq Python package and other custom software written in Python. The 3'-end of the sequenced transcript was aligned to the reference genome using Bowtie ("bowtie-bio" preceeding ".sourceforge.net") and the RNAP profiles generated in MochiView ("johnsonlab.ucsf" preceeding ".edu/mochi.html").

Plasmid Design and Construction for CRISPRi in Human Cells

The sequence encoding mammalian codon optimized Streptococcus pyogenes Cas9 (DNA 2.0) was fused with three C-terminal SV40 nuclear localization sequences (NLS) or to tagBFP flanked by two NLS. Using standard ligation independent cloning we cloned these two fusion proteins into MSCV-Puro (Clontech). Guide sgRNAs were expressed using a lentiviral U6 based expression vector derived from pSico which co-expresses mCherry from a CMV promoter. The sgRNA expression plasmids were cloned by inserting annealed primers into the lentiviral U6 based expression vector that was digested by BstXI and XhoI.

Cell Culture, DNA Transfections and Fluorescence Measurements for CRISPRi in Human Cells HEK293 cells were maintained in Dulbecco's modified eagle medium (DMEM) in 10% FBS, 2 mM glutamine, 100 units/mL streptomycin and 100 m/mL penicillin. HEK293 were infected with a GFP expressing MSCV retrovirus using standard protocols and sorted by flow cytometry using a BD FACS Aria2 for stable GFP expression. GFP expressing HEK293 cells were transiently transfected using TransIT-LT1 transfection reagent (Mirus) with the manufacturers recommended protocol in 24 well plates using 0.5 µg of the dCas9 expression plasmid and 0.5 µg of the RNA expression plasmid (with 0.25 µg of GFP reporter plasmid for FIG. 45B). 72 hours following transfection, cells were trypsinized to a single cell suspension. The U6 vector contains a constitutive CMV promoter driving a mCherry gene. GFP expression was analyzed using a BD LSRII FACS machine by gating on the mCherry positive populations (>10-fold brighter mCherry over the negative control cells).

Figure 40A:
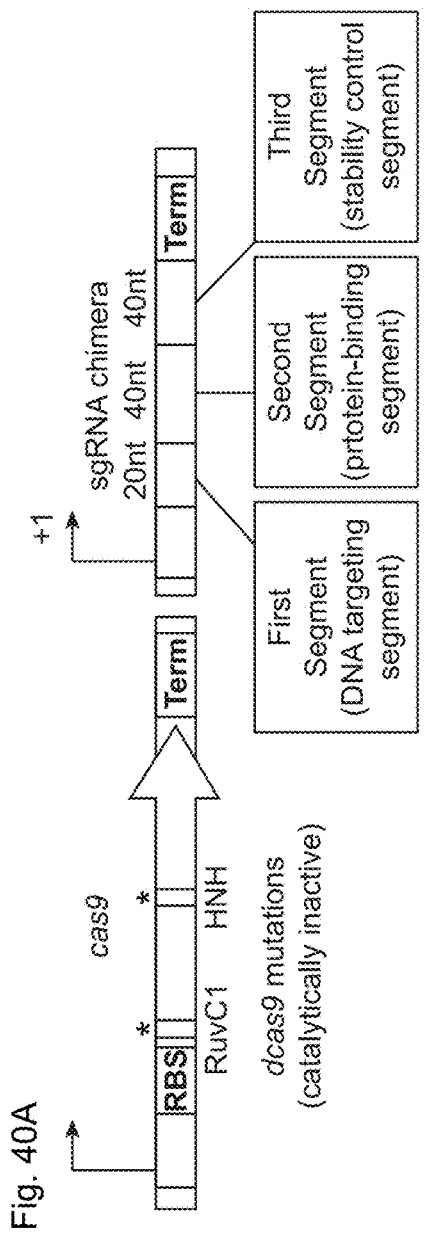
Figure 40B:
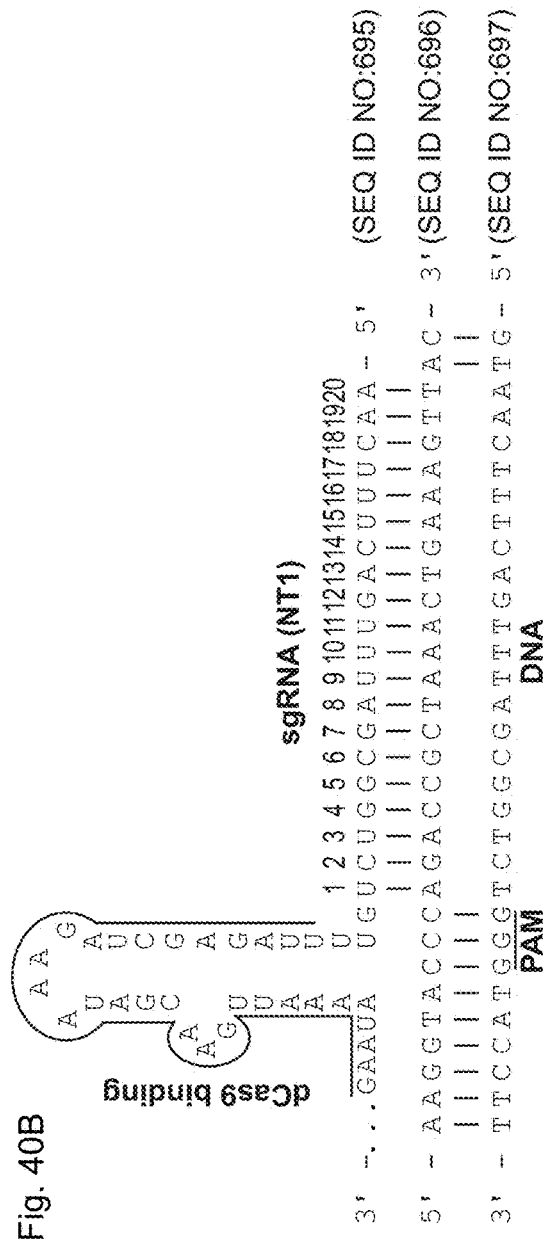
Figures 40C, 40D:
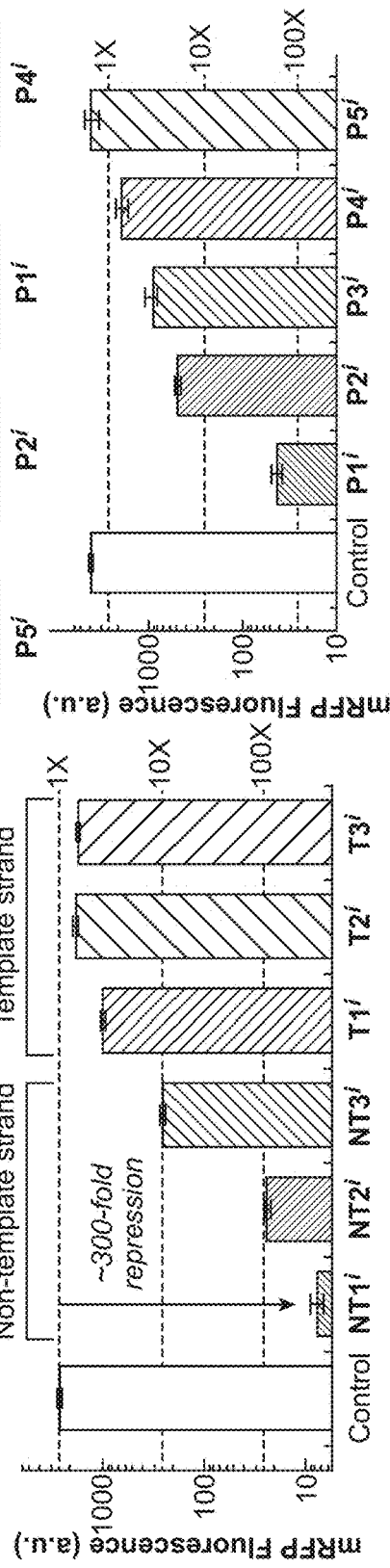
Figure 43A:
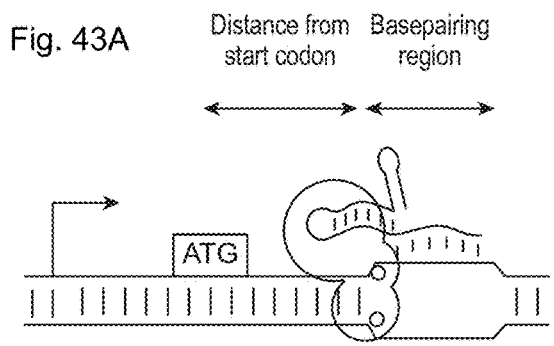
Figure 43B:
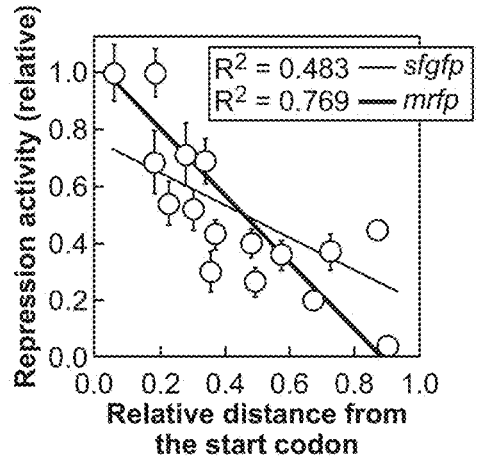

Designed RNAs sgRNA designs used in the Figures: only the 20 nucleotide matching region (DNA targeting segment) are listed (unless otherwise noted):

The mRFP-targeting sgRNAs used in FIG. 40C (SEQ ID NOs:741-746);

The promoter-targeting sgRNAs used in FIG. 40D (SEQ ID NOs:747-751);

Target promoter sequence in FIG. 40D (SEQ ID NO:752);

The mRFP-targeting sgRNAs used in FIG. 43B (SEQ ID NOs:753-760);

The sfGFP-targeting sgRNA (gfp) used in FIG. 42B (SEQ ID NO:761);

The sfGFP-targeting sgRNAs used in FIG. 43B (SEQ ID NOs:762-769);

The double-sgRNA targeting experiments in FIG. 43F and FIGS. 51A-51C (SEQ ID NOs:770-778);

The lac operon-targeting sgRNAs used in FIG. 44B (SEQ ID NOs:779-787); and

The EGFP-targeting sgRNAs used in FIG. 45A-45B (SEQ ID NOs:788-794).

TABLE 3

Sequences used in the FIGURES of Example 4 (listed above)

| Sequence | SEQ ID NO: |
| --- | --- |
| T1 | 741 |
| T2 | 742 |
| T3 | 743 |
| NT1 | 744 |
| NT2 | 745 |

TABLE 3-continued

Sequences used in the FIGURES of Example 4 (listed above)

| Sequence | SEQ ID NO: |
|---|---|
| NT3 | 746 |
| P1 | 747 |
| P2 | 748 |
| P3 | 749 |
| P4 | 750 |
| P5 | 751 |
| R1 | 770 |
| R2 | 771 |
| R3 | 772 |
| R4 | 773 |
| R5 | 774 |
| R6 | 775 |
| R7 | 776 |
| R8 | 777 |
| R9 | 778 |
| lacZ | 779 |
| lacI | 780 |
| lacY | 781 |
| lacA | 782 |
| crp | 783 |
| cya | 784 |
| A site | 785 |
| O site | 786 |
| P site | 787 |
| eT1 | 788 |
| eT2 | 789 |
| eNT1 | 790 |
| eNT2 | 791 |
| eNT3 | 792 |
| eNT4 | 793 |
| eNT5 | 794 |

Results

The CRISPR (clustered regularly interspaced short palindromic repeats) system provides a new potential platform for targeted gene regulation. About 40% of bacteria and 90% of archaea possess CRISPR/CRISPR-associated (Cas) systems to confer resistance to foreign DNA elements. CRISPR systems use small base-pairing RNAs to target and cleave foreign DNA elements in a sequence-specific manner. There are diverse CRISPR systems in different organisms, and one of the simplest is the type II CRISPR system from *Streptococcus pyogenes*: only a single gene encoding the Cas9 protein and two RNAs, a mature CRISPR RNA (crRNA) and a partially complementary trans-acting RNA (tracrRNA), are necessary and sufficient for RNA-guided silencing of foreign DNAs (FIG. 46). Maturation of crRNA requires tracrRNA and RNase III. However, this requirement can be bypassed by using an engineered small guide RNA (sgRNA) containing a designed hairpin that mimics the tracrRNA-crRNA complex. Base pairing between the sgRNA and target DNA causes double-strand breaks (DSBs) due to the endonuclease activity of Cas9. Binding specificity is determined by both sgRNA-DNA basepairing and a short DNA motif (protospacer adjacent motif or PAM, sequence: NGG) juxtaposed to the DNA complementary region. Thus, the CRISPR system only requires a minimal set of two molecules—the Cas9 protein and the sgRNA, and therefore holds the potential to be used as a host-independent gene-targeting platform. It has been demonstrated that the Cas9/CRISPR can be harnessed for site-selective RNA-guided genome editing (FIG. 39A).

FIG. 46 depicts the mechanism of the type II CRISPR system from *S. pyogenes*. The system consists of a set of CRISPR-associated (Cas) proteins and a CRISPR locus that contains an array of repeat spacer sequences. All repeats are the same and all spacers are different and complementary to the target DNA sequences. When the cell is infected by foreign DNA elements, the CRISPR locus will transcribe into a long precursor transcript, which will be cleaved into smaller fragments. The cleavage is mediated by a transacting antisense RNA (tracrRNA) and the host RNase III. After cleavage, one single protein, Cas9, recognizes and binds to the cleaved form of the crRNA. Cas9 guides crRNA to DNA and scans the DNA molecule. The complex is stabilized by basepairing between the crRNA and the DNA target. In this case, Cas9 causes double-stranded DNA breaks due to its nuclease activity. This usually removes cognate DNA molecules, and cells confer immunity to certain DNA populations.

FIG. 39A-39B depicts the design of the CRISPR interference (CRISPRi) system. (FIG. 39A) The minimal interference system consists of a single protein and a designed sgRNA chimera. The sgRNA chimera consists of three domains (boxed region): a 20-nucleotide (nt) complementary region for specific DNA binding, a 42-nt hairpin for Cas9 binding (Cas9 handle), and a 40-nt transcription terminator derived from *S. pyogenes*. The wild-type Cas9 protein contains the nuclease activity. The dCas9 protein is defective in nuclease activity. (FIG. 39B) The wild-type Cas9 protein binds to the sgRNA and forms a protein-RNA complex. The complex binds to specific DNA targets by Watson-Crick basepairing between the sgRNA and the DNA target. In the case of wild-type Cas9, the DNA will be cleaved due to the nuclease activity of the Cas9 protein. In the case of nuclease defective Cas9, the complex disrupts appropriate transcription. A minimal CRISPRi system consists of a single protein and RNA and can effectively silence transcription initiation and elongation To implement such a CRISPRi platform in *E. coli*, the wild-type *S. pyogenes* Cas9 gene and an sgRNA were expressed from bacterial vectors to determine if the system could perturb gene expression at a targeted locus (FIG. 40A). The *S. pyogenes* CRISPR system is orthogonal to the native *E. coli* system. The Cas9 protein is expressed from an anhydrotetracycline (aTc)-inducible promoter on a plasmid containing a p15A replication origin, and the sgRNA is expressed from a minimal constitutive promoter on a plasmid containing a ColE1 replication origin. As an alternative strategy, a catalytically dead Cas9 mutant (dCas9), which is defective in DNA cleavage, was used and showed that this form of Cas9 still acts as a simple RNA-guided DNA binding complex.

FIG. 40A-40E demonstrates that CRISPRi effectively silences transcription elongation and initiation. (FIG. 40A) The CRISPRi system consists of an inducible Cas9 protein and a designed sgRNA chimera. The dCas9 contains mutations of the RuvC1 and HNH nuclease domains. The sgRNA chimera contains three functional domains as described in FIG. 39A-39B. (FIG. 40B) Sequence of designed sgRNA (NT1) and the DNA target. NT1 targets the non-template DNA strand of mRFP coding region. Only the region surrounding the base-pairing motif (20-nt) is shown. Base-pairing nucleotides are numbered and the dCas9-binding hairpin is overlined. The PAM sequence is underlined. (FIG. 40C) CRISPRi blocked transcription elongation in a strand-specific manner A synthetic fluorescence-based reporter system containing an mRFP-coding gene was inserted into the *E. coli* MG1655 genome (the nsfA locus). Six sgRNAs that bind to either the template DNA strand or the non-template DNA strand were co-expressed with the dCas9 protein, with their effects on the target mRFP measured by in vivo fluorescence assay. Only sgRNAs that bind to the non-template DNA strand showed silencing (10~300-fold).

The control shows fluorescence of the cells with dCas9 protein but without the sgRNA. (FIG. 40D) CRISPRi blocked transcription initiation. Five sgRNAs were designed to bind to different regions around an *E. coli* promoter (J23119). The transcription start site was labeled as +1. The dotted oval shows the initial RNAP complex that covers a 75-bp region from −55 to +20. Only sgRNAs targeting regions inside the initial RNAP complex showed repression (P1-P4). Unlike transcription elongation block, silencing was independent of the targeted DNA strand. (FIG. 40E) CRISPRi regulation was reversible. Both dCas9 and sgRNA (NT1) were under the control of an aTc-inducible promoter. Cell culture was maintained during exponential phase. At time T=0, 1 μM of aTc was supplemented to cells with OD=0.001. Repression of target mRFP started within 10 min. The fluorescence signal decayed in a way that is consistent with cell growth, suggesting the decay was due to cell division. In 240 min, the fluorescence reached the fully repressed level. At T=370 min, aTc is washed away from the growth media, and cells were diluted back to OD=0.001. Fluorescence started to increase after 50 min, and took about 300 min to rise to the same level as the positive control. Positive control: always without the inducer; negative control: always with 1 μM aTc inducer. Fluorescence results in 2C, 2D, and 2E represent average and SEM of at least three biological replicates. See also FIGS. 47A-47B and FIG. 48.

The sgRNA molecules co-expressed with Cas9 each consist of three segments: a 20-nucleotide (nt) target-specific complementary region, a 42-nt Cas9 binding hairpin (Cas9 handle) and a 40-nt transcription terminator derived from *S. pyogenes* (FIG. 40B). A red fluorescent protein (mRFP)-based reporter system, was inserted it into the *E. coli* MG1655 genome.

Co-expression of the wild-type Cas9 protein and an sgRNA (NT1) targeted to the mRFP coding sequence dramatically decreased transformation efficiency, likely due to Cas9-induced double-stranded breaks on the genome (FIG. 47A). Sequencing of a few survivor colonies showed that they all had sequence rearrangements around the target mRFP site on the genome, suggesting that there was strong selection against expression of wild-type Cas9 and an sgRNA targeted to a host sequence. The dCas9 mutant gene (non-cleaving), which contained two silencing mutations of the RuvC1 and HNH nuclease domains (D10A and H841A), alleviated this lethality, as verified by transformation efficiency and *E. coli* growth rates (FIG. 47A&FIG. 47B).

FIG. 47A-47B is related to FIGS. 40A-40E and shows Growth curves of *E. coli* cell cultures co-transformed with dCas9 and sgRNA. (FIG. 47A) Transformation efficiency for transforming *E. coli* cells with two plasmids. One plasmid contains an sgRNA that targets to a genomic copy of mRFP and the other plasmid contains the wild-type Cas9 or dCas9. Co-transformation of wild-type Cas9 and sgRNA is highly toxic, which can be alleviated using dCas9. (FIG. 47B) The sgRNA (NT1) is designed to target the coding sequence of mRFP. Co-expression of dCas9 and sgRNA exhibits almost no effects on cellular growth rates, suggesting the dCas9-sgRNA interaction with DNA is strong enough to block RNA polymerase but not DNA polymerase or cell replication. The results represent average and SEM of at least three independent experiments.

To test whether the dCas9:sgRNA complex could yield highly efficient repression of gene expression, sgRNAs complementary to different regions of the mRFP coding sequence were designed, either binding to the template DNA strand or the non-template DNA strand. The results indicated that sgRNAs targeting the non-template DNA strand demonstrated effective gene silencing (10 to 300-fold of repression), while those targeting the template strand showed little effect (FIG. 40C). The system exhibited similar repression effects for genes that were within the *E. coli* genome or on a high-copy plasmid (FIG. 48). Furthermore, targeting to the promoter region also led to effective gene silencing (FIG. 40D). Targeting of the sgRNA to the −35 box significantly knocked down gene expression (P1, ~100-fold of repression), whereas targeting to other adjacent regions showed a dampened effect (P2-P4). Targeting sequences about 100-bp upstream of the promoter showed no effects (P5). Unlike targeting the coding sequence, when targeting the promoter, the efficiency of silencing is independent of the DNA strand; targeting of template or non-template strands is equally effective (P2 and P3).

FIG. 48 is related to FIG. 40C and shows that CRISPRi could silence expression of a reporter gene on a multiple-copy plasmid. The mRFP gene was cloned onto a p15A plasmid. Presence of the dCas9 and an mRFP-specific sgRNA (NT1) strongly represses mRFP (~300-fold). The repression effect is similar to that observed using the mRFP in the genome (FIG. 40C). Silencing is only effective when the sgRNA acts on the nontemplate DNA strand but not the template DNA strand (T1). Also, silencing is highly specific, as a GFP-specific 3 sgRNA (gfp) shows no effect on mRFP expression. Fluorescence results represent average and SEM of at least three biological replicates.

CRISPRi Gene Knockdown is Inducible and Reversible

Figure 40E:
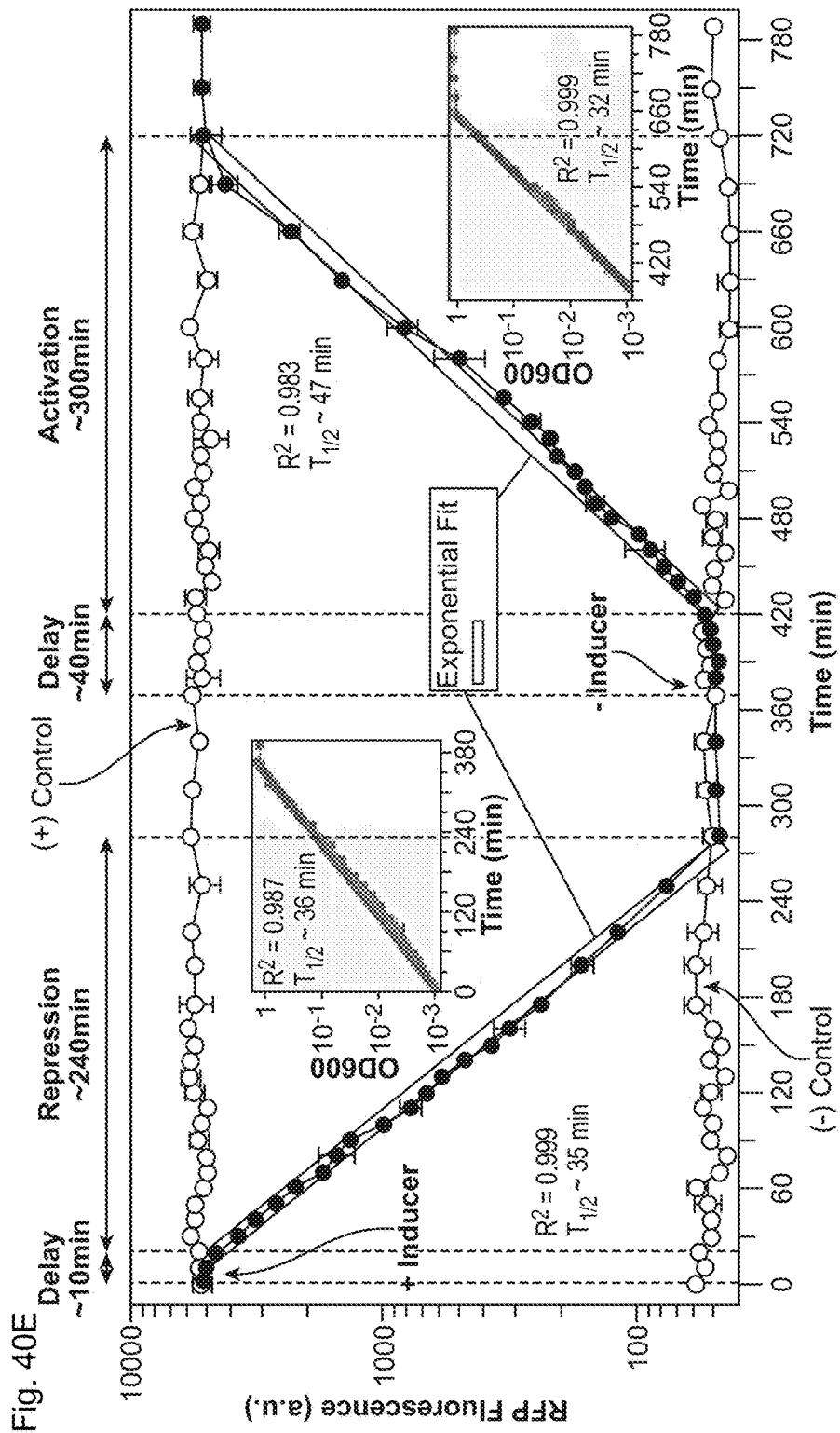

Unlike gene knockout methods, one advantage of using CRISPRi-based knock down of gene expression is the fact that this perturbation should be reversible. To test if CRISPRi regulation could be induced and subsequently reversed, both dCas9 and mRFP-specific sgRNA (NT1) were placed under the control of the aTc-inducible promoter, and time-course measurements of CRISPRi-mediated regulation of mRFP in response to inducers were performed (FIG. 40E). At time zero, cell culture that grew to the early exponential phase without inducers was supplemented with 1 μM of aTc. The data indicated that the system could quickly respond to the presence of inducers—the fluorescent reporter protein signal started to decrease within 10 min of the addition of the inducer molecule. Because the mRFP protein is stable, the rate of fluorescence signal decrease is limited by protein dilution due to cell growth, as seen by a similar cell doubling time and loss of fluorescence half-time (both ~36 min). At 240 min, all cells were uniformly repressed to the same level as the negative control. At 420 min, the inducer was washed away from the growth media and cells were diluted back to a lower OD. After a delay of 50 min, mRFP fluorescence started to increase. It took a total 300 min for single-cell fluorescence to increase to the same level as the positive control. The 50 min delay is most likely determined by the dCas9/sgRNA turnover rate offset by dilution by cell growth and division. In summary, these results demonstrate that the silencing effects of dCas9-sgRNA can be induced and reversed.

Native Elongating Transcript Sequencing (NET-Seq) Confirms that CRISPRi Functions by Blocking Transcription dCas9 appeared to be functioning as an RNA-guided DNA binding complex that could block RNA polymerase (RNAP) binding during transcription elongation. Since the non-template DNA strand shares the same sequence identity as the transcribed mRNA and only sgRNAs that bind to the non-template DNA strand exhibited silencing, it remained a possibility that the dCas9:sgRNA complex interacts with mRNA and alters its translation or stability. To distinguish these possibilities, a recently described native elongating transcript sequencing (NET-seq) approach was applied to *E. coli*, which could be used to globally profile the positions of elongating RNA polymerases and monitor the effect of the dCas9:sgRNA complex on transcription. In this NET-seq method, the CRISPRi system was transformed into an *E. coli* MG1655-derived strain that contained a FLAG-tagged RNAP. The CRISPRi contained an sgRNA (NT1) that binds to the mRFP coding region. In vitro immunopurification of the tagged RNAP followed by sequencing of the nascent transcripts associated with elongating RNAPs allowed for distinguishing the pause sites of the RNAP.

These experiments demonstrated that the sgRNA induced strong transcriptional pausing upstream of the sgRNA target locus (FIG. 41A). The distance between the pause site and the target site is 19-bp, which is in perfect accordance with the previously reported ~18-bp distance between the nucleotide incorporation of RNAP and its front-edge. This finding is consistent with a mechanism of CRISPRi in which the transcription block is due to physical collision between the elongating RNAP and the dCas9:sgRNA complex (FIG. 41B). Binding of the dCas9:sgRNA complex to the template strand had little repressive effect, suggesting that RNAP was able to read through the complex in this particular orientation. In this case, the sgRNA faces the RNAP, which might be unzipped by the helicase activity of RNAP. These experiments have demonstrated that CRISPRi utilizes RNAs to directly block transcription. This mechanism is distinct from that of RNAi, for which knockdown of gene expression requires the destruction of already transcribed messenger RNAs, prior to their translation.

FIG. 41A-41B demonstrates that CRISPRi functions by blocking transcription elongation. (FIG. 41A) FLAG-tagged RNAP molecules were immunoprecipitated and the associated nascent mRNA transcripts were sequenced. The top panel shows sequencing results of the nascent mRFP transcript in cells without sgRNA, and the bottom panel shows results in cells with sgRNA. In the presence of sgRNA, a strong transcriptional pause was observed 19-bp upstream of the target site, after which the number of sequencing reads drops precipitously. (FIG. 41B) A proposed CRISPRi mechanism based on physical collision between RNAP and dCas9-sgRNA. The distance from the center of RNAP to its front edge is ~19 bp, which matches well with our measured distance between the transcription pause site and 3' of sgRNA basepairing region. The paused RNAP aborts transcription elongation upon encountering the dCas9-sgRNA roadblock.

CRISPRi sgRNA-Guided Gene Silencing is Highly Specific

To evaluate the specificity of CRISPRi on a genome-wide scale, whole transcriptome shotgun sequencing (RNA-seq) of dCas9-transformed cells with and without sgRNA co-expression was performed (FIG. 42A). In the presence of the sgRNA targeted to mRFP (NT1), the mRFP transcript was the sole gene exhibiting a decrease in abundance. No other genes showed significant change in expression upon addition of the sgRNA, within sequencing errors. We also performed RNA-seq on cells with different sgRNAs that target different genes. None of these experiments showed significant changes of genes besides the targeted gene (FIG. 49A-49C). Thus sgRNA-guided gene targeting and regulation is highly specific and does not have significant off-target effects.

FIG. 42A-42C demonstrates the targeting specificity of the CRISPRi system. (FIG. 42A) Genome-scale mRNA sequencing (RNA-seq) confirmed that CRISPRi targeting has no off-target effects. The sgRNA NT1 that binds to the mRFP coding region was used. The dCas9, mRFP, and sfGFP genes are highlighted. (FIG. 42B) Multiple sgRNAs can independently silence two fluorescent protein reporters in the same cell. Each sgRNA specifically repressed its cognate gene but not the other gene. When both sgRNAs were present, both genes were silenced. Error bars represent SEM from at least three biological replicates. (FIG. 42C) Microscopic images for using two sgRNAs to control two fluorescent proteins. The top panel shows the bright-field images of the *E. coli* cells, the middle panel shows the RFP channel, and the bottom shows the GFP panel. Co-expression of one sgRNA and dCas9 only silences the cognate fluorescent protein but not the other. The knockdown effect was strong, as almost no fluorescence was observed from cells with certain fluorescent protein silenced. Scale bar, 10 µm. Control shows cells without any fluorescent protein reporters. Fluorescence results represent average and SEM of at least three biological replicates. See also FIG. 49A-49C.

FIG. 49A-49C is related to FIG. 42A and depicts the RNA-seq data of cells with sgRNAs that target different genes. (FIG. 49A) (+/−) sgRNA that targets the promoter of the endogenous lacI gene in *E. coli*. The same lad-targeting sgRNA was used as in FIG. 44A. (FIG. 49B) (+/−) 1 mM IPTG for cells without auto-inhibited sgRNA (sgRNA repressed its own promoter). (FIG. 49C) (+/−) sgRNA that targets the endogenous lacZ gene in *E. coli*. The same lacZ-targeting sgRNA was used as in FIG. 44A. 1 mM IPTG was also supplemented to cells with the lacZ-targeting sgRNA.

CRISPRi can be Used to Simultaneously Regulate Multiple Genes

The CRISPRi system can allow control of multiple genes independently without crosstalk. A dual-color fluorescence-reporter system based on mRFP and sfGFP was devised. Two sgRNAs with distinct complementary regions to each gene were designed. Expression of each sgRNA only silenced the cognate gene and had no effect on the other. Co-expression of two sgRNAs knocked down both genes (FIGS. 42B&42C). These results suggest that the sgRNA-guided targeting is specific, with the specificity dictated by its sequence identity, and not impacted by the presence of other sgRNAs. This behavior should enable multiplex control of multiple genes simultaneously by CRISPRi.

Factors that Determine CRISPRi Silencing Efficiency

To find determinants of CRISPRi targeting efficiency, the role of length, sequence complementarity and position on silencing efficiency was investigated (FIG. 43A). As suggested in FIG. 40C, the location of the sgRNA target sequence along the gene was important for efficiency. sgRNAs were further designed to cover the full length of the coding regions for both mRFP and sfGFP (Supplemental Data for sgRNA sequences). In all cases, repression was inversely correlated with the target distance from the transcription start site (FIG. 43B). A strong linear correlation was observed for mRFP. A similar, but slightly weaker correlation was observed when sfGFP was used as the target, perhaps indicating varying kinetics of the RNA polymerase during different points in elongation of this gene.

Figure 43C:
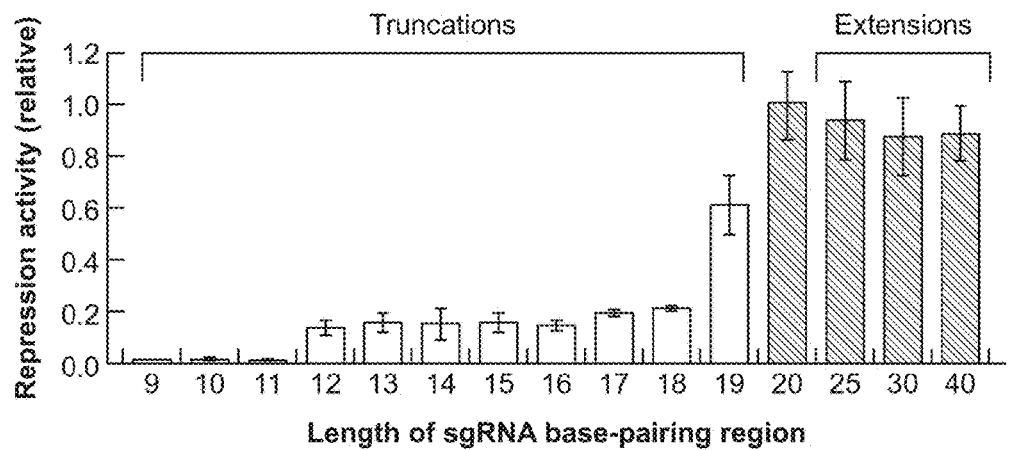
Figure 43D:
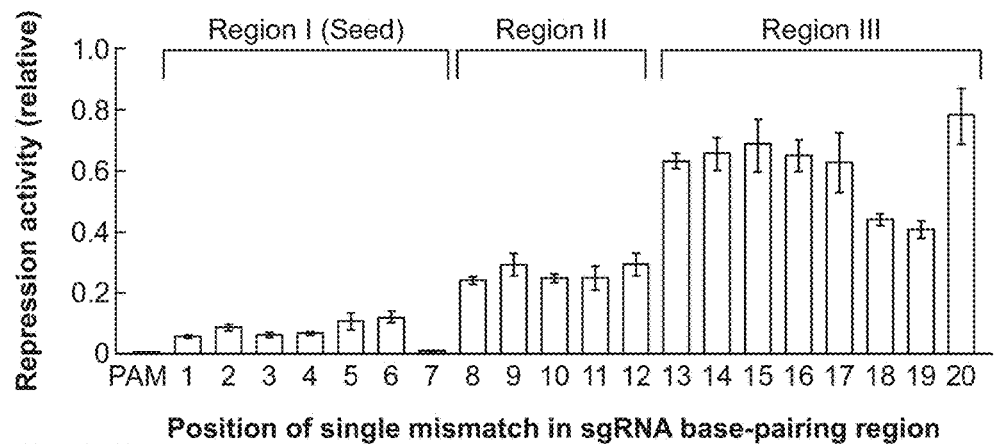
Figure 43E:
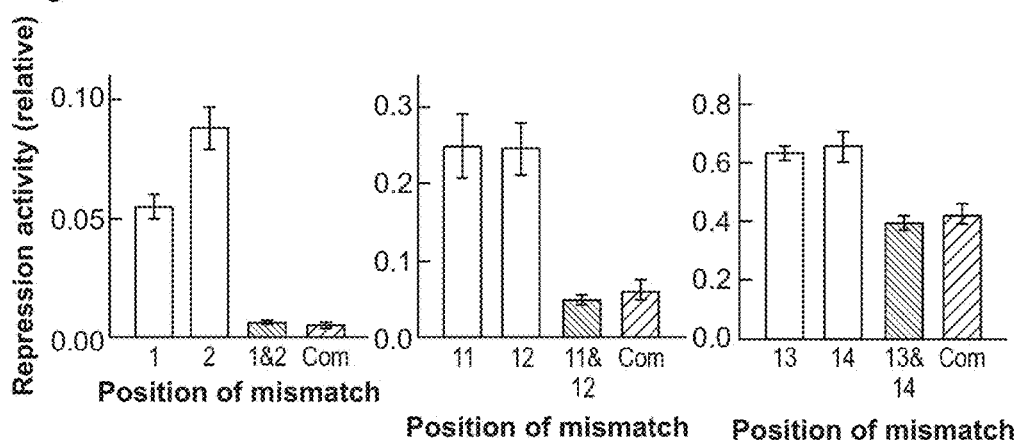

The sgRNA contains a 20-bp region complementary to the target. To identify the importance of this basepairing region, the length of sgRNA NT1 was altered (FIG. 43C). While extension of the region from the 5' end did not affect silencing, truncation of the region severely decreased repression. The minimal length of the basepairing region needed for gene silencing was 12 bp, with further truncation leading to complete loss of function. Single mutations were introduced into the basepairing region of sgRNA NT1 and the overall effect on silencing was tested. From the results, three sub-regions could be discerned, each with a distinct contribution to the overall binding and silencing (FIG. 43D). Any single mutation of the first 7 nucleotides dramatically decreased repression, suggesting this sequence constitutes a "seed region" for binding, as noted previously for both the type I and type II CRISPR systems. Adjacent nucleotides were also mutated in pairs (FIG. 43E and FIGS. 50A-50E). In most cases, the relative repression activity due to a double mutation was multiplicative, relative to the effects of the single mutants, suggesting an independent relationship between the mismatches. Furthermore, in agreement with previous results on the importance of the PAM sequence, an incorrect PAM totally abolished silencing even with a 20-bp perfect binding region (FIG. 43E). Thus, the specificity of the CRISPRi system is determined jointly by the PAM (2-bp) and at least a 12-bp sgRNA-DNA stretch, the space of which is large enough to cover most bacterial genomes for unique target sites.

Two sgRNAs both targeting the same gene were tested (FIG. 43F and FIGS. 51A-51C). Depending on the relative positioning of multiple sgRNAs, distinct combinatorial effects were observed. Combining two sgRNAs, each with about 300-fold repression, allowed for increased overall silencing up to a thousand-fold. Combining two weaker sgRNAs (~5-fold) showed multiplicative effects when used together. Suppressive combinatorial effects were observed when using two sgRNAs whose targets overlapped. This was probably due to competition of both sgRNAs for binding to the same region.

FIG. 43A-43F depicts the characterization of factors that affect silencing efficiency. (FIG. 43A) The silencing effects were measured of sgRNAs with different targeting loci on the same gene (distance from the translation start codon) and sgRNAs with different lengths of the basepairing region to the same target locus (based on NT1). (FIG. 43B) The silencing efficiency was inversely correlated with the target distance from the translation start codon (orange—mRFP & green—sfGFP). The relative repression activity was calculated by normalizing repression of each sgRNA to that of the sgRNA with the highest repression fold change. Error bars represent SEM from three biological replicates. (FIG. 43C) The length of the Watson-Crick basepairing region between the sgRNA and the target DNA affects repression efficiency. Extensions of the basepairing region all exhibited strong silencing effect, and truncations dramatically decreased repression. The minimal length of the basepairing region for detectable repression is 12-bp. Error bars represent SEM from three biological replicates. (FIG. 43D) Single mismatches were introduced into every nucleotide on sgRNA (NT1, FIG. 40B) how these single mismatches affected repression efficiency was measured. Three sub-regions with distinct importance to the overall silencing can be discerned. They show a step function. The first 7-nucleotide region was critical for silencing, and likely constitutes a "seed" region for probing sgRNAs binding to the DNA target. The PAM sequence (NGG) was indispensible for silencing. Error bars represent SEM from three biological replicates. (FIG. 43E) Silencing effects of sgRNAs with adjacent double mismatches. The relative repression activity of single-mismatched sgRNAs is shown with the mismatch position labeled on the bottom. Experimentally measured activity of double-mismatched sgRNAs is shown. Calculated activity by multiplying the effects of two single-mismatched sgRNAs is shown in white and labeled with "Com." In most cases, the silencing activity of a double-mismatched sgRNA was simply a multiplication of the activities of single-mismatched sgRNAs (except FIG. 50B), suggesting an independent relationship between single mismatches. Error bars represent SEM from three biological replicates. (FIG. 43F) Combinatorial silencing effects of using double sgR-NAs to target a single mRFP gene. Using two sgRNAs that target the same gene, the overall knockdown effect can be improved to almost 1,000-fold. When two sgRNAs bind to non-overlapping sequences of the same gene, repression was augmented. When two sgRNAs target overlapping regions, repression was suppressed. Error bars represent SEM from three biological replicates.

FIG. 50A-50E is related to FIG. 43E and depicts the silencing effects of sgRNAs with adjacent double mismatches. The relative repression activity of single-mismatched sgRNAs is shown with the mismatch position labeled on the bottom. Experimentally measured activity of double-mismatched sgRNAs is also shown. Activity calculated by multiplying the effects of two single-mismatched sgRNAs is shown in white and labeled with "Com". Fluorescence results represent average and SEM of three biological replicates.

Figure 43F:
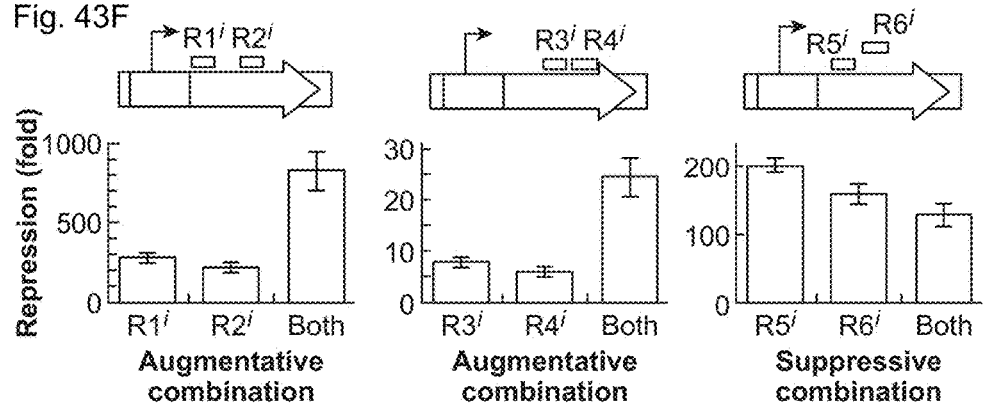

FIG. 51A-51C is related to FIG. 43F and depicts the combinatorial silencing effects of using two sgRNAs to regulate a single gene. In all cases, non-overlapping sgRNAs showed augmentative silencing effects, and overlapping sgRNAs showed suppressive effects. The combinatorial effect was independent of whether the sgRNA was targeting the template or non-template DNA strands. Fluorescence results represent average and SEM of three biological replicates.

Interrogating an Endogenous Regulatory Network Using CRISPRi Gene Knockdown

The CRISPRi system was next used as a gene knockdown platform to interrogate endogenous gene networks. Previous methods to interrogate microbial gene networks have mostly relied on laborious and costly genomic engineering and knockout procedures. By contrast, gene knockdown with CRISPRi requires only the design and synthesis of a small sgRNA bearing a 20-bp complementary region to the desired genes. To demonstrate this, CRISPRi was used to create *E. coli* knockdown strains by designing sgRNAs to systematically perturb genes that were part of the well-characterized *E. coli* lactose regulatory pathway (FIG. 44A). β-galactosidase assays were performed to measure LacZ expression from the knockdown strains, with and without Isopropyl β-D-1-thiogalactopyranoside (IPTG), a chemical that inhibits the lac repressor (LacI). In wild-type cells, addition of IPTG induced LacZ expression. The results showed that a lacZ-specific sgRNA could strongly repress LacZ expression (FIG. 44B). Conversely, an sgRNA targeting the lacI gene led to activation of LacZ expression, even in the absence of IPTG, as would be expected for silencing a direct repressor of LacZ expression.

It is known that cAMP-CRP is an essential activator of LacZ expression by binding to a cis regulatory site upstream of the promoter (A site). Consistently, the sgRNA that was targeted to the crp gene or to the A site in the LacZ promoter led to repression, demonstrating a means to link a regulator to its cis-regulatory sequence using CRISPRi experiments. Targeting the adenylate cylase gene (cya), which is necessary to produce the cAMP that makes CRP more effective at the LacZ promoter, only led to partial repression. Addition of 1 mM cAMP to the growth media complemented the effects for cya knockdown but not for crp knockdown, suggesting that cya is an indirect regulator of LacZ. Furthermore, targeting the LacI cis-regulatory site (O site) with an sgRNA led to inhibition, presumably because Cas9 complex binding at this site sterically blocks RNA polymerase, mimicking the behavior of the LacI transcription repressor. Targeting the known RNAP binding site (P site) also blocked expression. In summary, these studies demonstrate that the CRISPRi-based gene knockdown method provides a rapid and effective approach for interrogating the regulatory functions (activating or repressing) of genes and cis elements in a complex regulatory network (FIG. 44C).

FIG. 44A-44C demonstrates functional profiling of a complex regulatory network using CRISPRi gene knockdown. (FIG. 44A) sgRNAs were designed and used to knock down genes (cya, crp, lacI, lacZ, lacY, lacA) in the lac regulatory pathway or block transcriptional operator sites (A/P/O). LacI is a repressor of the lacZYA operon by binding to a transcription operator site (O site). The lacZ gene encodes an enzyme that catalyzes lactose into glucose. A few trans-acting host genes such as cya and crp are involved in the activation of the lacZYA system. The cAMP-CRP complex binds to a transcription operator site (A site) and recruits RNA polymerase binding to the P site, which initiates transcription of lacZYA. IPTG, a chemical that inhibits LacI function, induces LacZ expression. (FIG. 44B) β-galactosidase assay of the knockdown strains without (white) and with (grey) IPTG. Control shows that the wild-type cells without CRISPRi perturbation could be induced by addition of IPTG. The sgRNA that targets LacZ strongly repressed LacZ expression, even in the presence of IPTG. When LacI was targeted, LacZ expression was high, even without IPTG. Targeting cya and crp genes led to decreased LacZ expression level in the presence of IPTG. Presence of 1 mM cAMP rescued cya knockdown but not crp knockdown. Blocking the transcription operator sites resulted in LacZ repression, suggesting that these are important cis-acting regulatory sites for LacZ. Upon perturbation, decreased (down arrows) and increased (up arrows) expression of LacZ is indicated. Error bars represent SEM from three biological replicates. (FIG. 44C) The knockdown experiments allowed us to profile the roles of regulators in the lac regulatory circuit. The data is shown on a 2-D graph, with x-axis showing LacZ activity without IPTG and y-axis showing its activity with IPTG. The spreading of ovals along each axis shows the standard deviations. The (3-galactosidase assay results represent average and SEM of three biological replicates. For RNA-seq data on LacI and LacZ targeting, see also FIG. 49A-49C.

CRISPRi can Knock Clown Targeted Gene Expression in Human Cells

To test the generality of the CRISPRi approach for using the dCas9-sgRNA complex to repress transcription, the system was tested in HEK293 mammalian cells. The dCas9 protein was codon optimized, fused to three copies of a nuclear localization sequence (NLS), and expressed from a Murine Stem Cell Virus (MSCV) retroviral vector. The same sgRNA design shown in FIG. 40B was used to express from the RNA polymerase III U6 promoter. A reporter HEK293 cell line expressing EGFP under the SV40 promoter was created by viral infection. Using an sgRNA (eNT2) that targeted the non-template DNA strand of the EGFP coding region, a moderate but reproducible knockdown of gene expression was observed (46% repression, FIG. 45A). The repression was dependent on both the dCas9 protein and sgRNA, implying that repression was due to the dCas9-sgRNA complex and RNA-guided targeting. The same sgRNA exhibited better repression on the same gene when transiently expressed from a plasmid (63% repression, FIG. 52). Consistent with the bacterial system, only sgRNAs targeted to the non-template strand exhibited repression. Factors such as the distance from the transcription start and the local chromatin state may be critical parameters determining repression efficiency (FIG. 52). Optimization of dCas9 and sgRNA expression, stability, nuclear localization, and interaction will allow for further improvement of CRISPRi efficiency in mammalian cells.

FIG. 45A-45B demonstrates that CRISPRi can repress gene expression in human cells. (FIG. 45A) A CRISPRi system in HEK293 cells. The SV40-EGFP expression cassette was inserted into the genome via retroviral infection. The dCas9 protein was codon-optimized and fused with three copies of NLS sequence. The sgRNA was expressed from an RNA polymerase III U6 vector. Co-transfection of dCas9 and an sgRNA (eNT2) that targets the non-template strand of EGFP decreased fluorescence (~46%) while the expression of either dCas9 or sgRNA alone showed no effect. (FIG. 45B) The dCas9:sgRNA-mediated repression was dependent on the target loci. Seven sgRNAs were designed to target different regions of the EGFP coding sequence on the template or non-template strand. Only eNT2 and eNT5 showed moderate repression. Fluorescence results from 7A and 7B represent average and error of two biological replicates.

FIG. 52 is related to FIGS. 45A-45B and shows that sgRNA repression is dependent on the target loci and relatively distance from the transcription start. The same sgRNA was used to repress the same EGFP gene with different promoters. Cas9/sgRNA complexes repressed transcription from transiently transfected plasmid DNA. The level of transcriptional repression was slightly better (63%) than that observed for genomic genes, and the percentage of GFP-negative cells increased in the presence of sgRNA. The target locus has different distance from the transcription start. While SV40-EGFP showed repression, LTR-EGFP had no effect. Fluorescence results represent average and error of two biological replicates.

CRISPRi Efficiently and Selectively Represses Transcription of Target Genes

The CRISPRi system is a relatively simple platform for targeted gene regulation. CRISPRi does not rely on the presence of complex host factors, but instead only requires the dCas9 protein and guide RNAs, and thus is flexible and highly designable. The system can efficiently silence genes in bacteria. The silencing is very efficient, as no off-target effects were detected. Furthermore, the efficiency of the knockdown can be tuned by changing the target loci and the degree of basepairing between the sgRNA and the target gene. This will make it possible to create allelic series of hypomorphs—a feature that is especially useful for the study of essential genes. The system functions by directly blocking transcription, in a manner that can be easily programmed by designing sgRNAs. Mechanistically, this is distinct from RNAi-based silencing, which requires the destruction of already transcribed mRNAs.

In addition, these dCas9:sgRNA complexes can also modulate transcription by targeting key cis-acting motifs within any promoter, sterically blocking the association of their cognate trans-acting transcription factors. Thus, in addition to its use as a gene knockdown tool, CRISPRi could be used for functional mapping of promoters and other genomic regulatory modules.

CRISPRi is Amenable to Genome-Scale Analysis and Regulation

The CRISPRi method is based on the use of DNA-targeting RNAs, and only the DNA targeting segment needs to be designed for specific gene targets. With the advances of large-scale DNA oligonucleotide synthesis technology, generating large sets of oligonucleotides that contain unique 20-bp regions for genome targeting is fast and inexpensive. These oligonucleotide libraries could allow us to target large numbers of individual genes to infer gene function or to target gene pairs to map genetic interactions. Furthermore, CRISPRi could be used to simultaneously modulate the expression of large sets of genes, as the small size of sgRNAs allows one to concatenate multiple elements into the same expression vector.

CRISPRi Provides New Tools for Manipulating Microbial Genomes

Because the CRISPRi platform is compact and self-contained, it can be adapted for different organisms. CRISPRi is a powerful tool for studying non-model organisms for which genetic engineering methods are not well developed, including pathogens or industrially useful organisms. Unlike most eukaryotes, most bacteria lack the RNAi machinery. As a consequence, regulation of endogenous genes using designed synthetic RNAs is currently limited. CRISPRi could provide an RNAi-like method for gene perturbation in microbes.

CRISPRi as a Platform for Engineering Transcriptional Regulatory Networks

The CRISPRi can be utilized as a flexible framework for engineering transcriptional regulatory networks. The CRISPRi platform, because it is essentially a RNA-guided DNA-binding complex, also provides a flexible scaffold for directing diverse regulatory machinery to specific sites in the genome. Beyond simply blocking transcription of target genes, it is possible to couple the dCas9 protein with numerous regulatory domains to modulate different biological processes and to generate different functional outcomes (e.g transcriptional activation, chromatin modifications).

In the CRISPRi system, it is possible to link multiple sgRNAs into transcriptional circuits in which one upstream sgRNA controls the expression of a different downstream sgRNA. As RNA molecules in microorganisms tend to be short-lived, we suspect that the genetic programs regulated by sgRNAs might show rapid kinetics distinct from circuits that involve slow processes such as protein expression and degradation. In summary, the CRISPRi system is a general genetic programming platform suitable for a variety of biomedical research and clinical applications including genome-scale functional profiling, microbial metabolic engineering, and cell reprogramming.

Example 5: A Chimeric Site-Directed Polypeptide can be Used to Modulate (Activate or Repress) Transcription in Human Cells We have demonstrated that in human cells, a fusion protein comprising a catalytically inactive Cas9 and an activator domain or a repressor domain can increase or decrease transcription from a target DNA, respectively.

FIG. 55A-55D. We fused the humanized catalytically inactive Cas9 with a transcription activator domain VP64. (FIG. 55A) To test the efficiency for gene activation using this system, we inserted a GAL4 UAS inducible promoter that controls a GFP into the HEK293 (human tissue culture cells) genome. (FIG. 55B) The GAL4 UAS promoter can be induced in the presence of yeast-derived protein GAL4. The dCas9-VP64 fusion can effectively activate GAL4 UAS by 20-fold in the presence of a cognate guide RNA that binds to the GAL4 UAS region. (FIG. 55C) Microscopic images for dCas9-VP64 activation. (FIG. 55D) Flow cytometry data for dCas9-VP64 activation.

FIG. 56 We fused the humanized catalytically inactive Cas9 with a transcription repressor domain KRAB. (Top) We designed 10 guide RNAs that target a well-characterized promoter SV40 early promoter and one guide RNA that targets the EGFP coding region. (Bottom) Using a non-chimeric dCas9, we observed 2~3 fold repression for gRNAs of P9 and NT2. This efficiency was greatly improved using the dCas9-KRAB fusion. For example, with dCas9-KRAB fusion, P9 and NT2 showed 20-fold and 15-fold repression, respectively. In addition P1-P6 showed a significant reduction in expression when the fusion protein was used, but limited repression when a non-chimeric dCas9 was used.

Example 6: Cas9 can Use Artificial Guide RNAs, not Existing in Nature, to Perform Target DNA Cleavage An artificial crRNA and an artificial tracrRNA were designed based on the protein-binding segment of naturally occurring transcripts of *S. pyogenes* crRNA and tracrRNAs, modified to mimic the asymmetric bulge within natural *S. pyogenes* crRNA:tracrRNA duplex (see the bulge in the protein-binding domain of both the artificial (top) and natural (bottom) RNA molecules depicted in FIG. 57A). The artificial tracrRNA sequence shares less than 50% identity with the natural tracrRNA. The predicted secondary structure of the crRNA:tracrRNA protein-binding duplex is the same for both RNA pairs, but the predicted structure of the rest of the RNAs is much different.

FIG. 57A-57B demonstrates that artificial sequences that share very little (roughly 50% identity) with naturally occurring a tracrRNAs and crRNAs can function with Cas9 to cleave target DNA as long as the structure of the protein-binding domain of the DNA-targeting RNA is conserved. (FIG. 57A) Co-folding of *S. pyogenes* tracrRNA and crRNA and artificial tracrRNA and crRNA. (FIG. 57B) Combinations of *S. pyogenes* Cas9 and tracrRNA:crRNA orthologs were used to perform plasmid DNA cleavage assays .Spy— *S. pyogenes*, Lin—*L. innocua*, Nme—*N. meningitidis*, Pmu—*P. multocida*. *S. pyogenes* Cas9 can be guided by some, but not all tracrRNA:crRNA orthologs naturally occurring in selected bacterial species. Notably, *S. pyogenes* Cas9 can be guided by the artificial tracrRNA:crRNA pair, which was designed based on the structure of the protein-binding segment of the naturally occurring DNA-targeting RNA using sequence completely unrelated to the CRISPR system.

The artificial "tracrRNA" (activator RNA) used was 5'-GUUUUCCCUUUUCAAAGAAAUCUCCUGGGCAC-CUAUCUUCUUAGGUGCCCUCCCU UGUUUAAAC-CUGACCAGUUAACCGGCUGGUUAGGUUUUU-3' (SEQ ID NO:1347). The artificial "crRNA" (targeter RNA) used was: 5'-GAGAUUUAUGAAAAGGGAAAAC-3' (SEQ ID NO:1348).

Example 7: Generation of Non-Human Transgenic Organisms

A transgenic mouse expressing Cas9 (either unmodified, modified to have reduced enzymatic activity, modified as a fusion protein for any of the purposes outline above) is generated using a convenient method known to one of ordinary skill in the art (e.g., (i) gene knock-in at a targeted locus (e.g., ROSA 26) of a mouse embryonic stem cell (ES cell) followed by blastocyst injection and the generation of chimeric mice; (ii) injection of a randomly integrating transgene into the pronucleus of a fertilized mouse oocyte followed by ovum implantation into a pseudopregnant female; etc.). The Cas9 protein is under the control of a promoter that expresses at least in embryonic stem cells, and may be additionally under temporal or tissue-specific control (e.g., drug inducible, controlled by a Cre/Lox based promoter system, etc.). Once a line of transgenic Cas9 expressing mice is generated, embryonic stem cells are isolated and cultured and in some cases ES cells are frozen for future use. Because the isolated ES cells express Cas9 (and in some cases the expression is under temporal control (e.g., drug inducible), new knock-out or knock-in cells (and therefore mice) are rapidly generated at any desired locus in the genome by introducing an appropriately designed DNA-targeting RNA that targets the Cas9 to a particular locus of choice. Such a system, and many variations thereof, is used to generate new genetically modified organisms at any locus of choice. When modified Cas9 is used to modulate transcription and/or modify DNA and/or modify polypeptides associated with DNA, the ES cells themselves (or any differentiated cells derived from the ES cells (e.g., an entire mouse, a differentiated cell line, etc.) are used to study to properties of any gene of choice (or any expression product of choice, or any genomic locus of choice) simply by introducing an appropriate DNA-targeting RNA into a desired Cas9 expressing cell.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (1424 sequences)

SEQ ID NO: 1 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 2 - protein, 1368 aa, Streptococcus pyogenes [sequence omitted]

SEQ ID NO: 3 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 4 - protein, 1368 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 5 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 6 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 7 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 8 - protein, 1368 aa, Streptococcus pyogenes; identical to SEQ ID NO: 4

SEQ ID NO: 9 - protein, 131 aa, Helicobacter hepaticus
MRILGFDIGITSIGWAYVESNELKDCGVRIFTKAENPKNGDSLAAPRREARGARRRLARRKARLNAIKRLLCKEFELNLNDYLANDGELPKAYQTSKDTKSPYELYTAFHWIIFAFCSIASSLSNRQMLPI

SEQ ID NO: 10 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 11 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 12 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 13 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 14 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 15 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEEGALAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 16 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 17 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 18 - protein, 1122 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 19 - protein, 1128 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKRLRLQIKQNISNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 20 - protein, 1123 aa, Francisella tularensis
MNVKILPIAIDLDVKNTGVFSAFYQKGTSLEKLDNKNGKVYELSKDSYTLLMNNRTARRHKRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILGTLLTDDFDIWNFNFEKFDFDKNEEKLQNQEDKDHTQAHLHHFVFVVNKIKSEMASGGRHRSQYFQEITNVLDENNHQEGYLKNFCENLHNKKYSNLSVKNLVNLVGNLSNLELKPLRKYFNDKIHAKADHWDEQKFTETYCHWILGEWRVGVKDQDKKDGAKYSYKDLCNELKQKVTKAGLIDFLLELDPCRTIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDNNQLLTYCNHKPRQKRYQLLNDLAGVLQVSRNQLLSSVEEWFQQAQRVGEISKSQDEQIFEWLKSFKIASYCKAAVEMQKQYRGTLKNAIQTAIFRQSENINKNKNTGNQQQALSENSKDVKSLTADEKKLLKLIENIAKASQKIGESLGLNDKQIKKFNSIYSFAQIQQIAFAKRKGNANTCAVCSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNIFAIDTSKWFEIETPSDLRDIGVATIQYKIDNNSRPKVRVKLDYVIDDDSKINYFMNHSLLKSRYPDKVLEILKQSTIIEFESSGFNKTIKEMLGMTLAGIYNETSNN

SEQ ID NO: 21 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 22 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 23 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 24 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 25 - protein, 1370 aa, Streptococcus agalactiae; identical to SEQ ID NO: 5

SEQ ID NO: 26 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 27 - protein, 997 aa, Maritimibacter alkaliphilus
MKVLVDAGLMPSDPAAAKALETLDPYELRATGLDVMLPLTHLGRAVFHLNQRRGFKSNRKTDRGDNESGKIKDATKRLTWAMQEAGARTYGEFLHMRRARASDPRQVPSVRTRLSVASRGGPDSKEEAGYDFYPERAHLEDEFHALWSAQAAFHPDLTCELRDVVFEKIFYQRPLKEPKVGLCLFTAEERLPKAHPLTGRRVLYETVNQLRVTADGRTTRPLTLEERDMIVYALDNKKPVKSLSSMHLKLVALGKLVKLKDGERFTLESGVRDAIACDPIRATMGHPDGFGPAWSRLDWQAQWALIEKLRQVQSDDDFASLVAWLGATHNLSEDHAKRVANLHLPEGYGRLGLTATEAILCNLKAEVCTYSQAVERWGKHHSNQRTGECLEALPYYGEVLDRHVIPGTYNEDDDDVTRYGRITNPTVHIGLNQLRRLVNRIIATYGKPDQIVVELARELKQSEAQKSEALKKIRDTTADAIRRGRQLEEIGQKNTGANRLLLRLWEDLGPAVGPRCCPYTGKPISVTMLFDGACDVDHILPYSRTLDDSFANRTICLREANRQKGDRTPWEAWGGSDQWDAIEANLKDLPENKRKRFAPDAMERFEGERDFLDRALVDTQYLARISRAYLDTLFTEGGHVWVVPGRMTEMLRRHWGLNALLSDKDRGAGKVKNRTDHRHHAIDAAVIAATDHSLVNRISKAAGQGESAGQSAELIARDTPEPWEGFRNDISAQIARIVVSHRADHGRIDVEGRKHGKDSTAGRLHNDTAYGIVDDHTVVSRTPLLSLKPGDIEVTTKGKNIRDTQLQKALSVATTGKDGKGFEEALRNFAEKEGPYQGIRRVRLIETLQSSARVEVGSDEDGQPLKAYKGDSNHCYDLWKLPDGKVVPHVVSTYEAHAGTDKRPHPAAKRILRVFKKDMVAIEQDDQTAIFYVQKLDRANGLFLAPHLEANADARHRNPNDAFKFLQMGAGSVVRNKLRRVYVDEIGRIKDPGPPKH

SEQ ID NO: 28 - protein, 1027 aa, Blastopirellula marina
MFSESGDQPSLVDCGVRIFPEGVERDQQGGEKSKSQSRRVARGIRRQVRRRAQRLRHLKHALITTGLFPADVVDQQEVLASNPYELRSRALSEKLEPYEIGRILLHLAKRRGFLSNRTTDRSGGNELKGILAEMTQLQGEIAAHGCQTLGQYLHQLGDDGETFAQRLRGRHTLRAMYEDEFEKIWERQASYYPALLTEELRGGEEGKQSYPLVPTARRKSESLLKRFGLHGLLFFQRKMYWPKSVIGRCDLEPKEKRCPKADRLAQRFRILQEVNNLRLISPADRKEYTFAEFVGAGADKKLVDYLCEAKERTFPQIRKKFKLPETISFNYERGERSKLQGHETDAHFNGKKGLGKRRWSEIAEDVKDHIIQIVLEEDREDVALRKLTQDCSLTVEEAHKAMALHLPAGYSQYSRVAISRLLPHLELGKLLMGNDASDSAMHAAGYLRPDEREVRQYDLLPEPPDIPNPLVRQALYEVRKVINAIIREYGALGTIRVELAREAKKSAEQRTQIRIANAKRERENAAIAKTLQEMSPAIRPTRRNIQRYLLWKDQGGVCIYTGKVISQAQLFDSGEVDVDHILPRWRSLDDSMANKVIAHRSANNEKGDRTPWEWLGHDKPRFDELLLRAQRLPYGKRQRFIQKEVELTNFVERQLRDTTYVSRLVVQYLKGLGVPITTVKGPMTAELRHHWGLNALLNEDGSQKKNRSDHRHHAIDAIVIGLTDAKRLHALANARGKDLQPPWSEFRSDVATALGRMAVSHRVRRRIQGALHEETIYGPTQKAAQPTSTDQRPWAKDWIEDSQIVVRRKSVSDLTNTKHLAKIRDVTIRKILEDHLRRQKVDPTKPGVIPKDAFAGSNAPQMPSGVPIKKVRLVERGETWRKIGSGEASKFIKPGSNHHISYFAISRKGRESWKAHVTIMLDAACIAKESINNGKIVNRSIGDQGRFLMSLSIGEMFEITNNGGEILLCVVRKIDQSGRIYYKIHDDARESMDLKKDNLYMSPSKMQQFDARKVTVTPLGKIRNAND

SEQ ID NO: 29 - protein, 158 aa, Francisella tularensis
MIDFLLELDPCITIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLSEIYFQAKKLKQKASSELEKLESSKKLDEVIANSQLS

SEQ ID NO: 30 - protein, 393 aa, Francisella tularensis
MNVKILPIAIDLDVKNTGVFSAFYQKGTSLEKLDNKNGKVYELSKDSYTLLMNNRTAQRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQSQEDKDHTQAYFHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 31 - protein, 1066 aa, Rhodopseudomonas palustris
MSERVVRRILGIDLGIASCGWGVVDISGAGGGIIATGVRCFDAPLIDKTGEPKSATRRTARGQRRIVRRRRQRMNGVRRLLCEFGLLPDPRPDALNQAMRRISTASAAAQVTPWTLRAAAHQRLLSNEELAVVLGHIARHRGFRSNAKNEAGANAADETSKMKKAMEATREGLAKYHAFGDMIANDPKFANRKRNRDKDYSHTAKRSDLEDEVRAILRAQLRFGSAAATETLAQTFADVAFFQRPLQDSEDRVGDCPFEPGQKRAARRAPSFELFRFLSRLANLKLAVGRSPERRLTAEEIALAAKGFGETKKTITFKSLREALDLDPNARFSGIGKDKEASLDVVARTGGAAYGTKTLKDALGDAPWRSLSRTPETLDRIAEILSFREDITSIRNGLEDLGLDSLVVEALMQAAANGDFKEFTRAGHISARAARNIIPGLREGLVYSEACARVGYDHAARLSVPLDQVGSPVTRKALSEALKQVRAVAREYGPIDYFHIELARSVGKSAEERKQLTDGIEARNVEKAKRRKQAEEHLGRAPSDDELLRYELAKEQNFKCIYSGDAIDPAGVAANDTRYQVDHILPWSRFGDDSYLNKTLCTARSNQNKRGRTPFEWFEADKTDVEWMEYVARVENLQEVKGRKKRNYSIKDAAAIEDKFKARNLTDTQWATRLLADELSRMFPPRECERAICGRADGGNDGLTIVEERRVFTRPGAITSKLRRAWGLEGLKKQDGKRVEDDRHHAVDALVLAATTESLLQRLTVEVQRREREGRPDDIFHCAEPWRGFRADVRRTVYGSETMPGIFVSRAERRRARGKAHDATIKQIREIEGERLVFERKPVEKLTDKDLEKIPIPKPYGQVSDPKRLRDELVESLRAWIAAGKPKDRPPLSPKGDVIRKVRIQTNDKVSVEINGGTVDRGDMARVDVFRKKNKKAVWEYYVVPIYPHQIVALNDPPDRAVIAYAEDKDWKEIDSSYEFLWSLFGLSYVEISKANGECIDGYFRGLHRGTGAASVCKHISLGKDATVSGIGLKTLASFKKFTIDRLGRKFEIPREVRTWRGEACT

SEQ ID NO: 32 - protein, 1149 aa, Lactobacillus salivarius
MERYHIGLDIGTSSIGWAVIGDDFKIKRKKGKNLIGVRLFKEGDTAAERRGFRTQRRRLNRRKWRLKLLEEIFDPYMAEVDKYFFARLKESNLSPKDSNKKYLGSLLFPDISDSNFYDKYPTIYHLRRDLMEKDKKFDLREIYLAIHHIVKYRGNFLEKVPAKNYKNSGASIGFLLEEVNDLYGNIIGNEDVAILDNDKFEDVEKIILNDEIRNIDKQKNVGRLLVKDKKEKNIVTAFSKAIFGYKFNLEDLLLIESDEKNKLTFNDENIDDIFNELSHSLNDNQMDLLTKTREIYFKFKLNMIVPTGYTISESMIEKYEMHKAHLKMYKEFINTLNAKDRKILKNAYSDYINNEKAKAANAQENFYKTVKKTIKENDSDTAKKIIGLIDEGNFMPKQRTGENGVIPHQLHQIELDRIIENQAKYYPWLAEENPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKYKVLNELNNIKVNKKKLDVEQKQHVYLDLFTTRKNVTKDDLATSLNCDVESITGLTDNKKFNSSLSSYIDLKAILGNIVDDYSKNEDLEKIIEYSTIFEDGNIYKEKLSEISWLTDEQIEKLSNIHFKGWGRLSKKLLTQITNENGERIIDTLWNTSNNFIQVISDESIQAKLAEINGEYANKYNLEDILDEAYTSPQNKKAIRQVMKVVEDIEKAMKCEPTSIAIEFTREKRKSKLTNTRYKKISETYEKITDELISEYELGKLQSELDSKVNNMRDRYYLYFMQLGRDMYTGEKMNIDELHQKYDIDHILPQSFIKDDSLNNRVLTSKSVNIKEKSDKTAADLYAAKMGDFWRKLRKQGLMTEQKYKNLLTRTDSINKYTKQSFIKRQLVETSQVVKLAANILQDKYRNTKIIEIRARLNSDLRKKYELIKNREVNDYHHAIDGYLTTFVGQYLYKVYPKLRSYFVYDDFKKLDSNYLKHMDKFNFIWKLEDKKAEDVYDKVNDEFVLNVPEMKEYIRKIYNYKYMLVSKEVTTKNGAFYDQTKYNAKTINLIPIKKDKPTNIYGGYKGKVSSYMMLVKIQKKKEVIYKFVGVPRLWTDELDRLIDTDEKKALLKK

SEQ ID NO: 33 - protein, 1064 aa, Rhodopseudomonas palustris
MSECVTRRILGIDLGIASCGWGVIEVGEASGSIIASGVRCFDAPLIDKTGEPKSATRRTARGQRRIIRRRRQRMNAVRRLLAEFGVLTGRSPDALHQALLRLSQSVAGSQVTPWTLRAAAHERKLTNDELAVVLGHIARHRGFRSNSKNDGGANAADETSKMKKAMETTREGLARYHSFGAMIASDPKFADRKRNRDKDYSHTAKRSDLEDEVRTIFRSQTRFGSLVASEKLSQAFADAAFFQRPLQDSEDMVGSCPFEPGQKRTARRAPSFELFRFLSRLANLKLTVGRAPERRLTPDEIALAAKGFGETKKSITFKSLREALDLDPNARFSGVAKEKESTLDVAARTGGAAYGTKTLKDALGDAPWRSLSRMPEKLDRIAEILSFREDMKAIRNGLEEVGLDGLVVDALMQATANGDFKDFTRAAHISALAARNIIPGLREGLVYSDACTRVGYDHAARPAVPLSQIGSPVTRKALSEALKQVRAVAREYGPIDYFHIELARSIGKSAEERKKLTDGIEARNVEKEKRRKEAAEHLGRAPSDDELLRYELAKEQNFKCIYSGDPIDPAGISANDTRYQVDHILPWSRFGDDSYVNKTLCTARSNQNKRGRTPFEWFDADKTEAEWMEYSARVEDLKEVKGRKKRNYSIKDAASVEDKFKARNLTDTQWATRLLADELKRMFPPRECERVVTVRADGGNDGLSIVEERRVFTRPGAITSKLRRAWGLEGLKKQDGKRVEDDRHHAVDALVLAATTESLLNRLTVEVQQREREGRQDDIFHCSQPWPGFRVDVQRTVYGSETMPGIFVSRAERRRARGKAHDATVKQIRDIDGERIVFERKPIEKLTDKDLERIPVPEPYGKAADPKKLRDELVENLRAWIAAGKPKDKPPRSPKGDIIRKVRIETKDKVAVEINGGTVDRGDMARVDVFRKKNKKGVWEFYVIPIYPHQIVASALPPNRAVIAYKAESEWTAIDGCFEFAWSLNPMSYLELVKSNGELIEGYFRSMDRTTGAINLSPMSTNSETIRSIGVKTLSSFRKFTVDRLGRKFEIPREVRTWRGEACT

SEQ ID NO: 34 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 35 - protein, 641 aa, Nitrobacter hamburgensis
MHKRNSRSYRLGLDLGSNSLGWFVTHLEKRGDRYEPVALDPGGVRIFPDGRDPQSGMSNAVDRRMARGARKRRDRFVDPYALRKAALTNALPAHRVGRAIFHLNQRRGFQSNRKTDRKQSEDGAIKQAASKLKARMHEEAAPTLGAFFADMHLRKSYDDQQTAIRAELVRLGKDHLTGNARKKVWAKVRKRLFGDEVLRPKDTSDGARARATTTGTKASYDFYPTRAMLLDEFNAIWAAQREHHLAMTDEAKAEIEHIIFYHRPLKPAIVGKCTLDPATRPFKEDPEGYRAPWSHPLAQRFRILSEARNLEIRETGKTSRRLTKDQSDLVVAALLANREVKFDKLRTLLKLPAEARFNLESDRRSTATRPPHGCRTRRASIRRGAGFLRNGRSRSSPDWKKPKTKTNCSHGSKWNAHLTAQRPRASPIRRCRTAIAGSACAQSKRSCRSCRTSSMRMALRAPAITSWPSVPATTIPVDTFQQGGNAFGRILSVVTIELFAITDRVDPVQEQDARCFALRIAECRSDGLQHFAEVSLGLPPRNAAQDQRHSAGLCQSSCVGRFVPGTPCRRTPRSTSLHGKEPSAHAFGSTARSRPQLPASPRPCMSFRDGTSSSPARMPETLDRCAISRSNRSSVCRAERL

SEQ ID NO: 36 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 37 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 39 - protein, 1371 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGSD

SEQ ID NO: 40 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 41 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 42 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 43 - protein, 1629 aa, Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 44 - protein, 1068 aa, Verminephrobacter eiseniae
MNKAVAYRLALDLGSTSLGWAIFRLNEAREPTAIIRAGVRIFSDGRNANSEPLAVHRRVARAMRRRRDRLLKRKKRMHDQLVQHGFFPAEVAERKELERLNPYQLRAKGLHEALTPGEFARALFHINQRRGFKSNRKTDRKDNDSGALKQAISELRKRIQDSDCATAGEWFWKERMQQKPEGVRGQWVRARYRKTPSTTDEGKKRIGYDLYVDRAMVEQEFDALWAAQAALQPGLFTEAARAELKDTLLYQRDLRPVKPGRCTLLPAEERAPLALPSTQRFRILQEVNNLRLLDEALREVPLNLAQRDAVVSALEGKKELSFAAIRKLLTLSGKFNLEDEKRAELKGNATSVILARKDLFGDAWAGFDAAVQDEIVWRLVSQESEGALIAWLQQHTGVDGVCAEAIVNTRLPDGYGRLSRKALERIVPALQREVCTYDKAVQAAGFAHHSDLGFDFDYAEDEVQQVGEHTIASTGEVQAQYAFKQLPYYGKALQRHVAFGSGDAKDHEEKCYGKIANPTVHIGLNQVRTVVNALIRRYGHPTEVVVELARDLKQSREQKQQTQREQADNQKRNEDIRKRIAPILETSPERVRDRDIKKWILWEELNKKDIADRHCPYSGERISATMLLSEAVEIEHILPFSRTLDDSLNNRTVAMRRANRIKGDRTPWEARADFEAQGWRYEAILQRAEGMPPRKRYRFAEDGYQRWLGKDRNFLARALNDTSYLSRLAANYLRLVCPQGVRVIPGQMTDKLRGKFGLNSVLGLDGKKNRNDHRHHAVDACVIGVTDQGLMQRFANASKQARENGLTRLVQDMLLPWWPSYYDHVERAVRHIRVSHRPDHGFEGAMMKGTAHGIREDGIREDGRIKQRPKAKGSADHKTITLIPIDEPRQLARHGVDAEGKPLPYKGYASGSNYCIEITKNGKGKWEGQVISTFDAYRIKAAADAAARAGQVISTVEADSIVRKSGWERLRGAQSQNGQPLVMRLVIGDSVRMEVDGRDEVMRVVKMSGKEMVFAPVREANVDKRNNMPDEQDPFTYTYKRADQLRKAKARQVTISPIGELRDPGFKG

SEQ ID NO: 45 - protein, 1125 aa, Francisella tularensis
MNVKILPIAIDLDVKNTGVFSAFYQKGTSLEKLDNKNGKVYELSKDSYTLLMNNRTARRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKIQKFSYTDKQGNLKELSYYHHDKYNIQEFLKRHATINDEILDTLLTDDFDIWNFNFEKFDFDKNEEKLQNQEDKDHTQAHLHHFVFAVNKIKSEMASGGRHRSQYFQEITNVLDENNHQEGYLKNFCENLHNKKYSNLSVKNLVNLVGNLSNLELKPLRKYFNDKIHAKADHWDEQKFTETYCHWILGEWRVGVKDQDKKDGAKYSYKDLCNELKQKVTKAGLIDFLLELDPCRTIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDNNQLLTYCNHKPRQKRYQLLNDLAGVLQVSRNQLLSSVEEWFQQAQRVGEISKSQDEQIFEWLKSFKIASYCKAAVEMQKQYRGTLKNAIQTAIFRQSENINKNKNKNTGNQQQALSENSKDVKSLTADEKKLLKLIENIAKASQKIGESLGLNDKQIKKFNSIYSFAQIQQIAFAERKGNANTCAVCSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNIFAIDTSKWFEIETPSDLRDIGVATIQYKIDNNSRPKVRVKLDYVIDDDSKINYFMNHSLLKSRYPDKVLEILKQSTIIEFESSGFNKTIKEMLGMTLAGIYNETSNN

SEQ ID NO: 46 - protein, 1064 aa, Unknown
  Bradyrhizobium sp.BTAi1
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 47 - protein, 1354 aa, Flavobacterium psychrophilum
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTSIYKAFEKILEVEGYEIDFSKMKPLEIKETVAPIFETLNINTVILDFDPTIQGNDFDKQPYYQLWHLLYSAEDDDKLKETLKTKFGFKENHLPFILNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKASDLFSKNYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLRQDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLGLSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 48 - protein, 1062 aa, Actinobacillus succinogenes
MNLNYILGLDLGIASVGWAVVEIDEQENPQRLIDVGVRTFDRAEVLKTGESLALARRLARSSRRLVKRRAERIKKAKRLLKAENLLLSADEILPNEAWQLRVKGLDQKLERQEWAAVLLHLLKHRGYLSQRKNESKSENKELGALLSGVAINHQILQSAEYRTPAEIAVNKFQAEEGHIRNQRGAYTHTFSRLDLLAEMELLFQRQATLGNPHTSTKLLENLTALLMWQKPALAGEAILKMLGKCTFEPTEYKAAKNSYSAERFVWLTKLNNLRILEQGAERALTDNERFALLDQPYEKAKLTYAQVRTLLGLSDEAIFKGLRYQGEDKKAVETKTTLMEVKAYHQIRKALEGLDLKAEWNELKNNPALLDEIGTAFSLYKTDDDIHRYLDGKLSESVLNALLENLNFDKFIQLSLKALQQILPLMLQGQRYDEAVSAIYGDHYGKKSDEIDRLLPNIPTDEIRNPVVLRTLTQARKVINAVVRLYGSPARIHIETGREVGKSYQDRKKLEKQQEENRKQRENAVKKFKEYFPNFVGEPKGKDILKMRLYELQQAKCLYSGKSLELYRLLEKGYVEVDHALPFSRTWDDSFNNKVLVLANENQNKGNATPYEWLDGKNNSEGWQHFVARVQTSGFSYAKKQRVLIQELDEKSFIERNLNDTRYVARFLCNHIADNMLLTGKGKRKVFASNGQITALLRGCWGLQKVRENNDRHHALDAVVVACSTKSMQDKITKFVKYKEGRLFKDKKDGVYKGERINRETGEIISLHFPTPWKFFKENVEIRIFSENPKLELENRLPDYPQYNHEFVQPLFVSRMPTRKMTGQGHMETVKSAKRLDKGLSVLKVPLTQLKLSDLERMVNREREMALYEALKECLEQFGNDPAKAFAEPFYKKGGALVKAVRVEQTQKSGVLVRNGNGVADNATGSIVRVDVFTKGGKYFLVPIYTWQVAKGILPNKAVIQGKDESEWEEMDENAVFQFSMHKNDLIKVKTKKGEIFGYFNGLDRATGSIEIEEHDLEKSKGKNGSHRGLGVKTAFFLEKYQVDELGKNIRPCRPTKRQHVR

SEQ ID NO: 49 - protein, 1340 aa, Dorea longicatena
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLKI

SEQ ID NO: 50 - protein, 984 aa, Campylobacter jejuni
MAKILAFDIGISSIGWAFSENDELKDCGVRIFTKAENPKTGESLALPRRIARSARKRLARRKARLNHLKHLIANEFKLNYEDYQSFDEILAKAYKGSLISPYELRFRALNELLSKQDFARVILHIAKRRGYDDIKNNGDEEKGKILKAIKQNEEKLANYQSVGEYLYKEYFQKFKENSKEFINVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTLYTKDDLNALLNEVLKNGTLTYKQTKKLLGLSDDYEFKGEKGNYFIEFKKYKEFIKALGEHSLSQDDLNEIAKDITLIKDEIKLKKALAKYDLNENQIDNLSKLEFKDHLNISFKALKLITPLMLEGKKYDEACNELTLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNTAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREEFKNELR

SEQ ID NO: 51 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 52 - protein, 1107 aa, Eubacterium ventriosum
MGYTVGLDIGVASVGVAVLDENDNIVEAVSNIFDEADTSNNKVRRTLREGRRTKRRQKTRIEDFKQLWETSGYIIPHKLHLNIIELRNKGLTELLSLDELYCVLLSMLKHRGISYLEDADDGEKGNAYKKGLAFNEKQLKEKMPCEIQLERMKKYGKYHGEFIIEINDEKEYQSNVFTTKAYKKELEKIFETQRCNGNKINTKFIKKYMEIYERKREYYIGPGNEKSRTDYGIYTTRTDEEGNFIDEKNIFGKLIGKCSVYPEEYRASSASYTAQEFNLLNDLNNLKINNEKLTEFQKKEIVEIIKDASSVNMRKIIKKVIDEDIEQYSGARIDKKGKEIYHTFEIYRKLKKELKTINVDIDSFTREELDKTMDILTLNTERESIVKAFDEQKFVYEENLIKKLIEFRKNNQRLFSGWHSFSYKAMLQLIPVMYKEPKEQMQLLTEMNVFKSKKEKYVNYKYIPENEVVKEIYNPVVVKSIRTTVKILNALIKKYGYPESVVIEMPRDKNSDDEKEKIDMNQKKNQEEYEKILNKIYDEKGIEITNKDYKKQKKLVLKLKLWNEQEGLCLYSGKKIAIEDLLNHPEFFEIDHIIPKSISLDDSRSNKVLVYKTENSIKENDTPYHYLTRINGKWGFDEYKANVLELRRRGKIDDKKVNNLLCMEDITKIDVVKGFINRNLNDTRYASRVVLNEMQSFFESRKYCNTKVKVIRGSLTYQMRQDLHLKKNREESYSHHAVDAMLIAFSQKGYEAYRKIQKDCYDFETGEILDKEKWNKYIDDDEFDDILYKERMNEIRKKIIEAEEKVKYNYKIDKKCNRGLCNQTIYGTREKDGKIHKISSYNIYDDKECNSLKKMINSGKGSDLLMYNNDPKTYRDMLKILETYSSEKNPFVAYNKETGDYFRKYSKNHNGPKVEKVKYYSGQINSCIDISHKYGHAKNSKKVVLVSLNPYRTDVYYDNDTGKYYLVGVKYNHIKCVGNKYVIDSETYNELLRKEGVLNSDENLEDLNSKNITYKFSLYKNDIIQYEKGGEYYTERFLSRIKEQKNLIETKPINKPNFQRKNKKGEWENTRNQIALAKTKYVGKLVTDVLGNCYIVNMEKFSLVVDK

SEQ ID NO: 53 - protein, 1136 aa, Streptococcus gordonii
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 54 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 55 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 56 - protein, 1096 aa, Unknown
  Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 57 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPAEPKAAKNTYTAERFIWLTKLNNLRILEQGSERPLTDTERTTLIDEPYRKSKLTYAQARKLLELDNTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIDLPPIPADEIRNPVVLRALSQARKVINGVVRRYGSPARIHIETAREVGKSFKDRKEIEKRQEENRKDREKAATKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 58 - protein, 1050 aa, Gluconacetobacter diazotrophicus
MGENMIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALTISAHNDPKSIHSGIGTKTLLAISKYQVDRFGRKSPVRKEVRTWHGEACISPTPPG

SEQ ID NO: 59 - protein, 1391 aa, Kordia algicida
MKKILGLDLGTNSIGWALVNEAEHEHEQSSIVKLGVRVNPLSVDEKTNFEKGRPLSINADRTSKRSARRNLQRFKLRRKNLINLLLKHHIISNETILTEVGKNTTHQTLKLRSKATQEKISLEEFARILLSINKKRGYKSSRKEKNEDEGFTIDGMAIAKELYDNQLTPGQYVYNILQDGKNYIPDFYRSDLQAEFDDVWQFQKKFYSSILTDEFYLKLKGQGKENTRKLFLAIHQVYTAENKGKRDAVKLQYYKWRSEAVKKQLSIEEVAYVLVEINNNINKSSGYLGAISDRSKALYFNNETVGEYLYGQLVKNRHNSLRNQVFYRQDYLDEFEKIWETQAKFYDELTNELKQEIRDVVIFYQRKLKSQKHLISDCLFEKHHKAIPKSSPLFQEFKIWQNLNYLEFVHTQSKEKIFFSELDDETRQFVFAELNIRGTLKIKEIKKLIGLETPVYWKSNFDEIEGNRTNQVLYNVYQNIADDLGYGFDWSKKHAFEINAELQAIFKDVGIDTAILNFDASIEENDFDKQKSYQLWHLLYSAEDTDKATEEDKLIYGNINTKLKKQLHQKYGFEAKYGNLLANISLQQDYGNLSAKAIKKILPYLESGNSFYEACTIVGYNPSNSLTKEQQQNRKLKDKLELLPKNSLRNPVVEKILNQKVNLINQLIDEYGKPDEVRIELARELKKSAKQRADLSKHINDATLKNQNIRKTLQKDFGIQNPSKNDVIRYKLYDELKDNGYKTLFTNKYIPKEQLFSKDVDIEHIIPKAILFDDSFSNKTLAYRNVNLAKADATAFDFISSKHLDDLDNYKARVETLFQSKRISKGKYKKLLMTRQNLPEDFIERDLRNSQYIAKKATAMLKEVFRSVVPTSGRITDKLREDWDLVNVMKELNLPKYRTLGLTEFIERKNGNKIEQIIDWTKRNDHRHHAMDALTVAFTTHNHIQYLNNLNVTHGLNGVDTDHEKSRLYAIKQAITKVYIVGKTKKRKFIPPMENFRSHAKNHLEGILISFKNKNKVVTKNKNRTKTKTKGVFNEKIQLTPRGQLHKETIYGHAKKVIVTKEKVSSKFTHEKILQVTKPAYREALLKRLASFKNDPKKAFSGKNALSKNPLYFDITSGKKVPDTVKLSYFENSYVIRKEVNSDNFKNEKSLQKVLDVGIRRILEKRLADYNGNAKEAFSNLEKNPIWKDKEKGVCIKKVRIEALKNAEPLHVKKDHLGKIILDDENKSTPVDFISTGNNHHVAIYEDKDGKLHDKVVSFYEVVSRVNLGLPIIDKSFNSHLDWKFLFSMKQNEMFVFPSEDFNPKEIDIGNPKNNELISKYLFRVQKFSKVTYGNSAVRDYVFRHHLETELIDKKELKGITYYQLKSIGMLEKLVKVRINHIGKIVHIGEY

SEQ ID NO: 60 - protein, 1116 aa, Clostridium spiroforme
MVEFLLKEMKIMGRLVLGLDIGITSVGYGVIDIDKNEFVDYGVRLFKEGTAINNEERRSKRGARRLKRRKTNRIADMKKLLERNGLIDEQYTALNNPYEIRKKGLKNKLSNYELATAILHITKNRGTCLESNADETQDEESTKNILSKNALELKDKYICEIQLARLEESGKIRGINNNFKTEDYLKELSKILENQDLEKETIDKIKEIVARRRRYDQGPGSEKSPTPYGSYRMENGELVHVNLIDMMRGKCSVFPDQLRAPQQSYSAELFNLLNDLNNLKINGEKLSSTEKQKIIDFVNEKGGITVKQLLKLIDVGITEISGFRIDKNEKPLITEFKGYKKVLKVFKNYNQESLLNDKSIVDTIMDINTKIKSIDERSDQLKQVLPSLDTSIINDLASIKGVSGYHSLSLKALNLINNEMLKTEMNQMQVLHQLDIFDKNRVSLKGQRQIYADDNAILSPVAKRAHRETFKVINKLRSIYGEFDSIVIETTRDKNTQDQKKRIKNNQKNYEERNTEVNNFLKEAGYNPENINAKTKMKIRLYIEQDAKSAYTLQDINLKELIEDEKAYEIDHIIPISISLDDSFNNKVLTTHDENQEKGNLTPISAFLKGKFHNGNLNTYKVFIQNNKNLNRKKKEYLLCEDDITRYEVVQNFINRNLVDTSYACRTVMNTLVHYFKDNEINTKVHTIKGQATSTFRKRIGLIKDREEDYFHHAIDALIVASLKKMNLINSYLMKVDFNEMYDEETGEIFNVLPDNSYLDEKYISFVSNLKNIYEESNKYIRGVMIKEKMTYPLIKVSHKIDTKPNRKISDDTIYSTRNVDNQDMLVERIKNIYDPKENAANTLINDIINDNTDKYIMYHKDPQTFDKIKAIVLNHFNEFKTDKNCYIVTKEGLYKLKGTSPLALYYEEFGPITKYAKKNNGPTIHSMKFYSEKLGNHLSITHKYSTVNKKVITKQISPYRTDFYQSPEGKYKFVTVRYKDVAYNAKKDKYIIDHSWYREQKKLKKIADEWIFVCSVHRDELIGIMKADGQKRIFDSSTESDGETLYHDAKTYEILKFTATNNDITGRFEVKPIYCYCKKQLMVSIGTCRKIQKFATDVLGNLYIVKDNVLKLEFK

SEQ ID NO: 61 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 62 - protein, 1129 aa, Streptococcus infantarius
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 63 - protein, 1065 aa, Clostridium perfringens
MNKDINYALGLDIGITSVGWAVINLDLNRIEDLGVRIFNAAENLKDGSSLALPRRLARGRRRLLRRKAYRVERVRKLILKNNILTKEELEGLFKNKEVIDVWEARVKGLDYKLSREEWAKILINFCKRRGFKSNRKNEAKDKEAGQILSSISYNIEKMKETNSRTIGEYIYNEVKNSEDSYAPLRNKFGEYKMCVSRDVIREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEEELFSTLTYSIDKDISKTENTKFVSLKGYHEIKRAIEKGVSKKAWQDIENNRNLLNDIAYVLTLGKTDDEIEKQLRLRNVPEELFESLLDMSFNKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTVVEVLKYRLWEQQRGECAYTQSQIPLERLFSPGYCEIDHIIPFSRSFDDSLSNKILVLGSENQRKGNRTPYEYFGEDSERWNSFEIWVKGSYLNYKKKANLLKKKFSEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKSPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEGMVRIDIYEKEGKYFVVPVYRYQLAKGIVPKRAAIAKKDELKWPIMDQTYNFKFSIYKNDLIEVKYDKKGVYFGYYDGFDRNSASLTIEKHDNSERYRSIGLKVGVLEINKYEVDVLGNYHKVKLGGN

SEQ ID NO: 64 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 65 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 66 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 67 - protein, 166 aa, Unknown
  uncultured Termite group 1 bacterium phylotype Rs-D17
MNKVQEIEYKKIREKLADREYRIGLDLGVGSIGYVVVSLKECNDLSYLPEDIILSGSRIFKSSIGAVERREFRLQRNSHRHHRERMRFLWQLLAEKQLALQSSKDLEKKENSADCETSQKRFPINILKEDPYILRYKALEEKLSLFQLGYVLYHIANHSNTAYENT

SEQ ID NO: 68 - protein, 1032 aa, Unknown
  uncultured Termite group 1 bacterium phylotype Rs-D17
MLYHIANHRGTDSVRSFLEYDDDKIKENTLTAKIAKETKKVIDAKKYRTFGEYLYKGKIEKFQQNIRKKVSNRKTPANKNKEFAVTRDVIIKETEKILASQKQYYTYILTDEYIKKIKDAISYQTEKLIPESGYCPYFKDEKRLPRSHKLNEYRRMYEALNNAKYFDPVLDENTGEILSYQEKEFSREEKKILFDEVLLKGMELTESGAKKLLYHLPDGCEVQLQGRDKTTQKIKGYALVDLEASPFWLRLSQQQQDEFLYDWNSLPLEKLKPKLTNYYSLTESEVDETFQEIKLPSNYASVGKKAMEILLTYIKDGCSYTEALEKAVSEGKLKVDKQTMIYDSLPYYGKILKESTQKLIGKAFSKQFADRNYKEPDTNKNEREFGKIANPVVHQTLNELRKLINEIITVFGKKPLEIGLETTRELKKSKKNREYLSKQQNKNEYARNRIYKEYIEPHLSQIKSRQENPSKYISKFELLEEQNFICPFCSEKITPDDIINSKVDVEHIFPIEESEDITKNNLVIAHNECNADKGKKSPFDAFGDKTSGKYRWNCILHNAQKNLPHKVWRFYQGSLEKFLENKPMSRRFGTDNSYISKIAARYLACLFNDPYHSEIFCIKSSLIAQLRIAWDLNSIMVPLVKNILSEKELEEFKISKNKKIRIDNRHHALDAIVIAYANRGYHNFLNRIHAKEYKINYREKSWLSKILLPPLNRDLEDFKISVKDSIEKANVSIKHDHNTNGSLVKATAYKVYYSGAGEYIITTSKNVEEISFKEKEDPKDTLYRALCKFECRDIDIKDEKLIKKLKYNSTLYKKVQNNLSKAKQELEQDNKKTEEEGKKSQKITEVRIYKKACSLVKGQYIQCGSRLKDKFFAVKEPTEIKTGLGYDTGDNLFLDLYYDKTGKLCGEIIRKVNFNRNKPNYQKEGYTLFERIYQSDILEVDTSEDRISLKNKTGSAPSDRTFIKVNTFTEVNAYFDGKRDKIQIFFGNLLKSSFKNDSFFISSMQKYNVRKVILTSLGIIKYRSQILKNKEV

SEQ ID NO: 69 - protein, 1032 aa, Unknown
  uncultured Termite group 1 bacterium phylotype Rs-D17
MKKRILGLDIGIASVGWALVEFDDEFQDNKKKGTIIKSGVRIFTRAETPKERESLAKPRREARSQRRRIRRRVERLNSIRELFVKNGVVEEWSVSKKNPNNIYITLNQIKTPWQLRMESLDRKLTNEQFAVVLTHLAKHRGYKSLRKDDKAGKVLEAISQNKKRLNDSDYRTLGEMFCKNESYKEHKRNKGGEYINSVARELIEEEVEKIFVKQREKGNNFADVNTEREYLKIAFSQKPAGSISKMVGFCTFENGEKRAPRDSYSAELFKVLCTINNTTFTDMKTGEIRSFSKEEIGKTLETVKNVKDVKYAKIRKDLGLEDSVKFSGVDYRENAKSKGEGEIFVSMKTYHEIKSKIEKLSKEKWDNLKGNTELLDSIVNIIANLKDDESIKKEFQKLKIDEDIIDVLLNFEFKKFINLSFKALRKIIPFQFQGQKYITASTSAGYSLKQEGIKNKLVPPAKENINVAVVARAFAQTRKVINAVIRKYGQFDQINIELATELKNSKFDRSKIEEGQKKFQSQKDKIFKEVQELRGGMTPSSSLLLKYRLWREQDERCVYSGRKISFEDLLDTGFLDIDHIIPYSKSMDDSFNNKVLCLAEENRNKKNDIPFNYYQRIDRDWNLLISIITSMKNMKIAKKSRLLKQELSDIEGFIERNINDTRYATRYIKDFLENNLEFKENEFIKVKVQARSGGLTSVLSYNWGMSKDREESYFHHAKDAIIVACSTQGMVQYISKISQQYENDKDKMKKIKDKTENCIPKPWDSFRADVEESIEGIFVSFAPRHKVTGSAHKETIYSKKHLEKERYVTVKKSLDKIKLSDLENIPCNENCGIIRVLKERLEKFKNDSLKAFADPVHMPTKCPNKKGPVIRSVKIKESNKTGIEVRKGLAERGEMVRVDVFIKDKKYYLVPIYVSDFKNKDLPNKAIAALKLENEWIMIDKTYSFKFSLFKDDLIKIKKKKEEIFGYFGGVHRSTGTIKIKSRHKPKEIDEGIGSRCLLDFRKFQVDVLGNYTEVKHEKRMPAYITRKDKKH

SEQ ID NO: 70 - protein, 1361 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 71 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 72 - protein, 1341 aa, Ruminococcus lactaris
MGKGYYVGLDMGTGSVGWAVTDESYQILRRHGKAMWGVRLFESAKTAEERRMFRTGRRRLDRRGWRIEILQEIFAEEISRVDPGFFLRMKESKYYPEDKRDIQGNCPELPYTLFVDKTFTDKDFHKKYPTIYHLRKMLMETEDTPDMRLVYLALHHMMKHRGHFLLSGDISQVTEFKNTFNQFIENIRNEEMDFEIELDESAVQMIEETLKDKNLTRSAKKSKLVKGLNAKNVRDKAFLTLLSGGTVKLSDLFGMEELNEGERPKISFADNGYEEYAAVVEMELGELYYIVESAKAVYDWAILSDILGGSTSVSDAKVRAYEKHKADLKYLKAVVKEYFPKEVYNAVFVESSDKLNNYPAYIGMTKKNGKKVSLEGKRCSREEFMDFLKKNIVVKLPDEEAKMYLQSELEKDSFLPKQVNKDNGVIPYQVHKYELKKILDNLGDKIPFLKENAEKIEKLFSFRIPYYVGPLRTGNGENSKFAWAERKSTEKIYPWNFENVIDVEQSAENFIRRMTNKCTYLIGEDVLPKDSLLYSKFMVLNELNNLRLDGQKISVELKQKIYRDVFCRSRKVTQKKLKSYLIREGIAGKNVELTGIDGDFKGSLTAYHDFKEKLIDVELTQKEKEEIILNIVLFGDDKKLLKQRLKKKFPQLTEKQINTVTALSYKGWGRLSKKLLEEVTVPAPETGEVWNIITALWETNDNFMQLLSKEYQFSDRIEEFNEEKADPEVSYQTIEDLYVSPAVKRQIWQTLQIIQEIEKVMGEKPKRVFVEMAREKQENKRTESRKKTLSDLYTKCKKEEPEWIEALCTSLEKHEEHQLRSDKLYLYYTQKGRCMYSGEPIDLEDLWDNTKYDIDHIYPQSKTMDDSLKNRVLVKKEYNAKKSDTYPIAADIQKKMMPFWKSLLTGGFIPKEKYDRLVRNNPLDANELAGFIERQIVETRQSTKAVAEILKKILPDTEIVYVKAKTVSKFRQDFDFIKVRDMNDLHHAKDAYLNIVVGNVYFVKFTKNAAWFVKENPGRTYNLEKMFIWDVARDGEIAWKAGKSGSIVQVRAMMEKNHILVTRRSYEVKGGLFDQQILKKGKGQVPVKESDERLRDIGKYGGYNKAAGVYFMLVSSKDKKGKEQRTIEFVPIYLKDRVEKDMESARNYLMEERGLREPKILIKKIKIDTLFKVDGFYMWLSGRTSNQLIFKGANQLILSKEDMKTLKKVVKYIQRQKEDKNVKISMRDGITEEELLKLYETFLDKIRHSIYGARLSSQEKTLVNGKEKFIDLSVEAKCQVLYEILHLFQCQSGAANLKMIGGPASAGILVMNNNISKCKNISIVNQSPTGIYEKEIDLLRV

SEQ ID NO: 73 - protein, 1003 aa, Gluconacetobacter diazotrophicus
MIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALIPTPVGPDSYVIA

SEQ ID NO: 74 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 75 - protein, 1504 aa, Bacteroides dorei
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNYPNLITDDKKVPYDWTIYYLRKKGLTSKISKEELAWILLNFNQKRGYYQLRGEEEEENKDKLVEFYALKVVAVEDSGEKKGKDIWYNVHLENGWVYRRTSNMSLDWVGKTKEFIVTTDLEKDGTPKKDKEGNVKRSFRAPKEDDWSLVKKKTEADIDQTHKTVGAYIYDTLLGNPSQKIRGRLVRTIERKYYKEELKLILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIINLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSYYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNKSATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 76 - protein, 1426 aa, Capnocytophaga sputigena
MKNILGLDLGITSISFAHIVEDENKEKSEIKELGVRIVSLTTDEQSDFEKGKSITTNANRTLKHGARLNLDRYQQRRKYLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQREFDLVWNFQKQFYPDILTDSFYKELQGKGKDATSKAFSKRYHFDTAENKGSKESVRLQAYQWRAEAISKQLSKEEVAYVLTEINNNLNNASGYLGAISDRSKELYFNRQTVGQYLYAQLQENRHNSLKNKVFYRQDYLDEFERIWETQASFHKELTDELKKQIRDVVIFYQRKLKSQKGLISFCEFESKEIEIEKDGKTITKTIGARVVPKSSPLFQEFKIWQILNNVTCKRKGIRKKKSSAKSTELDLFNEPSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIKEKVKDIFQALGICTKILYFDPLLPVKEFEKQDSYQLWHLLYSYESDDSTSGNETLYRILEKKYAFKREHARILANVALQDDYGSLSTKAIRKIYPNIKENQYSKACELAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKKFGIKNPTKSDIIRYRLYQELEHNGYKELYTNAPIARDMLFSKNIEIEHIVPKARVFDDSFSNKTLTFHRINSNKGEYTAFDYITSLNSEEELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNVNKPAGTDKQQITLTPRGQLHKETIYGKYQYYVNKEEKVGVKFDERTITKVSNPLYREALLKRLQANDNDPKKAFTGKNALSKNPIYLDETKTKTLPEKVNLTYLEEDFSIRKDISPDNFKDLKSIEKVIDQGVKRILIKRLQDYDNDPKKAFVDLEKNPIWLNKEKGIAIKRVTISGVSNAQPLHIGKDHLGKTTLNKEGNEIPVDYVSTGNNHHVAIYRDKEGNLQEQIVSFFEAVVRTQQGLPIIDKTYKQEEGWQFLFTMKQNEMFVFPNATTGFNPAEIDLLDPKNKKLISPNLFRVQKIATKDYFFRHHLETNVETDNVLKNTTWKREGLSGLKDIVKVRINHLGDIVSIGEY

SEQ ID NO: 77 - protein, 1443 aa, Parabacteroides johnsonii
MIKLLYLEKLKQYTMKKILGLDLGTSSIGWALVNEAENSDEVSSIIKLGVRVNPLTVDEMQNFEKGKSITTNADRTLKRSMRRNLQRYKLRRDALIELLKKVGFITDKTILSEQGNRTTFETYRLRAKAAEEEISLKELARVLLMINKKRGYKSSRKAKGEEEGALIDGMEIAKKLYDEDLTPGQLCLQLLESGKKFFPDFYRSDLQEEFNKIWDFQKQFNLFSFCDVAKEEVKGKNKSQTWAILAKYFVETKKVNVWNEHEAQTENREEVYKLVGLKRTVKGEELKKENYRWRVQALTEQLDLEKIAVVLQEINGQISASSGYLGAISDRSKVLYFNRQTVGQYQMAELNKNPNMSLRNMVFYRQDYLDEFNVIWEKQAEFHKELTPELKKEIRDIIIFYQRRLKSQKGLISFCEFENREVVVEKEGKKQTKIIGCKVIPRSHPLFQEFKIWQTLNNIEVFVGEKKGKRKKSNVSSDLFGDTEDALITEGRRFLYQEEKKILAKELSIKKGLTKAEILRLLFENPQELDINFKQIDGNQTGFALFSAYSNMIEKYGYEPLDFKKPAEDLISQLKTVFTDLGWNTDLLFIDLDKENKEWEKQPYFRLWHLLYSFEGDNTPTGNGKLIEKIMQLCGIEKEYAIELANVSLQDDYGSLSAKAIKKILLYLKEGNQYDMACEYAGYRHSKSSLTKEEIENKVLKDKLEILPKNSLRNPVVEKILNQMVNVINTVMEVYGRPDEIRVELARELKKSAKEREELTKAVAKNTREHEEIRKVLQSEFGMINVSRNDIIRYKLYEELKDNGYKTLYSNQYIPREKLFSKEIDIEHIIPQSRLFDDSLSNKTLEYKSINIEKGNKTAYDFVKEKYGEEGLQQYLNRCENLCKDKKAKLRKLKMELNEIPDGFIDRDLRNTQYIAKKALSMLTEICRRVVATTGSITDKLREDWQLVDVMKELNLPKYEALGLVEVYEDKDGRKIKRIKDWTKRNDHRHHAMDALTVAFTKDVFIQYFNNKNAAWESDSKEHTNIVGIKTRYFESGKAVPPIPLGQFRVEAKCHLENLLVSIKAKNKVVTTNVNCIKKKGGTYKNTQQTPRGQLHLETIYGSHNQYVTKIEKVNASFDAVKIATVSKQDYRNALLKRLEVFGNDPKKAFTGKNSLEKNPIYLDRAQTIQVPDKVQTVELETAYTIRKPVDPTLNVDKVVDKKIRLILEQRLKEYGGDAKKAFVNLDENPIWLNEEKGISIKRVTIRGISKAQALHDKKDKDGNFILDETGKRIPVDFVNTGNNHHVAIYRKPVLDKKGQVIFDDEGNPMYELDEDVVPFFEAVTRANLGIPIIDKDYKKSEGWQFLFSMKQNEYFVFPNEKTGFNPKEVDLLDPDNYAMISPNLFRVQKIGLNDYTFRHHLETTIQNDLKFITWIRCGKSGIKDIVKVRINHIGQIVSVGEY

SEQ ID NO: 78 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 79 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 80 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 81 - protein, 1131 aa, Acidovorax ebreus
MAQHVFGLDIGIASVGWAILGEQRIIDLGVRCFDKAETAKEGDPLNLTRRQARLLRRRLYRRAWRLTQLSRLLKRKGLIADAKLFAKAPSYGDSAWELRRQGLDRLLTPLEWARVIYHQCKHRGFHWTSKAEEAKADSDAEGGRVKQGLAHTKALMQAKNYRSAAEMVLAEFPDAQRNKRGQYDKALSRVLLGEELALLFATQRRLGNPHASDFFEKLILGDGDRKSGLFWQQKPALSGADLLKMLGKCTFEKGEYRAPKASFSVERHVWLTRLNNLRIVVDGRSRPLNEAERQAALLLPYQTETSKYKTLKNAFIKAGLWGDGVRFGGLAYPSQAQIDAEKTKDPEDQFLVKLPAWHELRKAFKAAGHEALWQQISTPALDGDPTLLDQIATVLSVYKDGAEVVQQLRQLALPEPAASIAVLEKISFDKFSSLSLKALRRIVPLMQSGLRYDEAVAQIPEYGHHSQRIEPGAAKHLYLPPFYEAQRKYAGKGDHIGSMQFRDDADIPRNPVVLRALNQARKVVNALIREYGSPIAVNIEMARDLSRPLDERNKVKRAQEEFRDRNDRARSEFERDFGYKPKAAAFEKWMLYREQLGQCAYSQQPLDIQRVLDDHNYAQVDHALPYSRSYDDSKNNKVLVLTHENQNKGNRTAFEYLTSFPDGEDGERWRTFVAWVQGNKAYRMAKRNRLLRKNYGVDESKGFIDRNLNDTRYICKFFKNYVEEHLQLAARADGDTARRCVVVNGQLTAFLRARWGLTKVRGDSDRHHALDAAVVAACTHGMVKALADYSRRKEISFLQEGFPDPETGEILNPAAFDRARQHFPEPWTHFAHELKARLFTDDLAALREDMQRLGSYTTEDLGRLRTLFVSRAPQRRSGGAVHKETIYAQPESLKQQGGVIEKILLTSLKLQDFDKLLNPESNDHFVEPHRNERLYAAIRQRLEQFGGRADKAFGPDNLFHKPDKNNQPTGPVVRSIKLVRGKQTGIPIRGGLAKNDSMLRVDIFTKAGKFHLVPVYVHHRVTGLPNRAIVAFKDEDEWTLIDESFAFLFSVYPNDYVKVTLKKEQQSGYYSGADRSTGAMNLWAHDRAASVGKDGLIRGIGVKTALSVEKFNVDVLGRIYLAPPETRSGLA

SEQ ID NO: 82 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWGEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 83 - protein, 1509 aa, Bacteroides coprophilus
MKKTLGLDLGTNSIGWAVINSNIDSEGKEKLVGISSCGSRIIPMDATTLGDFGKGNTKSPVAERTRLRGIRRLLERSLLRRERLHRVLSVMGFLPEHYASQLDRYGKFLPETEPKLAWYKDDSGRYQFLFQKSFHEMLEDFRQHQPELVAGEKKIPYDWTIYYLRKKALSQEITKEELAWILLNFNQKRGYYQLRGEEEQEENNKSVEYHALKVVSVEDSGERKGKDIWYNVTLENGWVYRRASNIPLDWTGKVKEFVVTTELDDAGNPKKDKEGNVKRSFRAPKEDDWGLLKTRTQAQIDESGKTVGTYIYESLLCMPNQKIRGKLVRTIERKYYKDELRQILVKQSEFHAALQDHNLLLSCIEELYPNNEAHRRLLSASSFIYFLIEDILFYQRPLKSQKGLIDNCPYESHIYKDKKDGSLHHVPLKCVSKSHPLFQEFRLWQFLSNLRIYQRERMMDGSLKLDVDVTREFLPSEEDYVKLFDWLNERKEISQKFLLAYKPFGLKKNEQANYRWNYVEDKSYPCNETRAEIKSRLSKAGVPEEFLTEEKEEALWHILYSISDKKELTKALGTFAAKNCLNESFVEVFAKIPPFESNYAAYSLKAIRKLLALMRMGKYWNEQAIDRQTRDRIEKILTGEYDETIRSRVREKAMLLTDISSFRGLPLWLACYIVYDRHSESKELVKWETPADIDHFLSKFKQNSLRNPIVEQVITESLRTVRDIWKQEGKIDEIHVELGREMKNPAKERARITAQVQENENTNLRIKALLAEFMNPEFEIENVHPYSPGQQEILRIYEDGVLSGIAEKDLPDDITAILKKFRENDVKKRPTTSEVLRYKLWLEQRYRSPYTGRVIPLGKLFTPAYEIEHVIPQSRYFDDSISNKVICESAVNKLKDNCLGYEFIKKHSGEMVELGNGETVPVFSVEEYERFVKESYFGNSKKMKKLLLEDIPDSFIERQLNDSRYISRVVTSLLSNLVCEEGEQDGLSKNVIVCTGGITDRLKKDWGVQEVWNRIILPRFLRLNEITGRTDFTSTSVNGHLLPALPLYLQKGFNKKRIDHRHHAMDAIVIACANRNIVNYLNNSSARKNSEISRYDLQRLLCEKVKTDANGNYKWILRKPWETFTQDVYAALTNIVVSFKQNLRVINRTTNYYQHYNEAGEKRMIPQTKGDRWAIRKPMHKDTVYGEVNLRKEKTLPLRDVVKNPSIVVDKSLKNKLYELLKSQYDLKAIAKYFETHQDVWADVNLKKIKVYYFTKETNERFFATRKSLDPSFDQKKIEEEVTDTGVQKILLHHLQQNNNDPDMAFSPDGIDRMNQNMTILNDGKWHQPIYKVRTYEKADKFAVGESGNKAKKFVEAAKGTNLFFAVYESVQEDEAIGKQVCKRTFATIPLNEVIKRKKQGLPAAPEDLNGNLPKFVLSPNDLVYLPTEEERNSSRIIQPLDRERIYKMVSSSGSQCFFIKVFVANSIWDKNEYSSLNKMERAITNEMIKEICVPIKIDRLGNVSLIQI

SEQ ID NO: 84 - protein, 1219 aa, Bacteroides cellulosilyticus
MKEEVRGKNRSQTWAILAKFFVWSEKESVWNEKEARTEERVKEYKLVGLKRDTKGNELKLENYRWRVQALSEQLNPEIVAIVLQEINGQISASSGYLGAISDRSKQLYFNRQTVGQYLMSELEKDPNVSLRNRVFYRQDYLDEFDRIWEKQAEFHEELTVELKKEIRDIIIFYQRRLKSQKGLISFCEFEKREVVVEEDGRKKNKTVGCRVIPRSHPLFQEFKIWQTLNDIEVFAWDKQSKRKKADKSSILFDNSEDALLVEGKRFLYQEEKELLAKELFVKESMKKAEVLKLLFENYQELDLNFKQIDGNHTGFALFSAYSKMIEKYGYEPVDFKRSADEIIEKLETIFTNLGWNTELLSIDLSKEDKELERQSYFRLWHLLYSFEGDNTPTGNGKLLEKIMQLCDVEKEYAVELANVSFQEDYGSLSAKAIKKILPYLKEGNQYDVACDYAGYRHSRSSLTKDEIENKILKDKLEILPKNSLRNPVVEKILNQMVNLINTLIDTYGKPDEIRVELARELKKNAKEREELTKSIARNTREHDEIRQLLRTEFGMMNVSRNDIIRYKLYEELKDNGYKTLYSNEYIPREKIFSKEIDIEHVIPQARLFDDSLSNKTLEYRAINIEKGNKTAYDFVKEKYGNDGLEKFLNRCETLFKDKRTKLRKLKMEEKDIPEGFIDRDLRNTQYISKKAFAMLNEISRRVVATTGSITDKLREDWQLVDLMKELNLPKYEKLGMVEMFEDKDGRKIKKITDWTKRNDHRHHAVDALTVAFTKDVFIQFYNNKNAAWMPASKEHANITGIKARYFENGKALAPMPLAQFRAEAKRHLENLLVSIKAKNKVITSNVNRTKNKNGENRKLQQTPRGQLHLETVYGSHRQYATKIEKVNAAFDVTKIATVSKLAYRNALLKRLEAFGNDPKKAFTGKNTLEKNPLYLDENQTEMVPEKVQTVEFETVYTIRKPIDPNLSIDKVVDVKIRSVLEKRLKEYGGDAKKAFVNLDENPIWLNEAKGISIKRVSIRGISNAQSLHEKKDKDGNLILGKEGRKIPVDFVNTGNNHHVAIYKKPVLDKVGQVVLDEEGNPKYELDEVVVSFFDAVTRANLGQPIIDKDYRRSEGWQFLFSMKQNEYFVFPNDKTGFNPKEVDLLNPENYALISPNLFRVQKFAYKNYVFRHHLETTIKDTSSTLKGITWTDFRSSKGLDKIVKVRVDHIGQIVSIGEY

SEQ ID NO: 85 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 86 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 87 - protein, 686 aa, Coprococcus comes
MKKQDSPKNNMGYTAYNLNVLGYEEFAKRVELLFKDTDAVKRLNDSHMQMAEGFDLNALPGSPALRRGVSQAIKVLDDIVSVAGKAPDRIYLKVTRTASNSRKGKRTAKRSDKIKQALKALDADAAADLGAAKLLRELGMFDEKEINERIYLYFHQAGKCLYTGKPIDITRIASNDYYVDHVVPLAYRKDESLDNKVLVYAEASRYKSETLLVSPAVQRKMLPFWRMLRNAGLMSERKLNALIRTEISEGMLKSIIGRQFTENSWEAKLFTAAIAAKYPGTVVIPVKAGVIGAVRSRIGIPKSLKANQFYHAHDALLAAEVGRYMELAKPAFVHNRVKYEQYMRKIKLVNEENKKAPKSQLDFFAGGFFFDRVDKDTGEVYWNKDEEVERIYRACGWKNLRVTYAAFEDGGAFWKQTIYSPREKSKLIATKSDRPAEIYGGYSSQTFANFFVYEVMKKKVKQLRFGAVPAAIASKSDPDTYNAMLEMYARGLAKTAKEKFVRIVRARVLKNTMIELYGERFRIAGEKQVYPVRQMPLAIDEVYLLKGVETIAAAGNAGASAKIDFEKAAESLVGFWDLLLEKLPVNYPKLTVQLKLGLLKHPKDILAATSESEFPAIVYKIAEAEIQVMEQASGLRNMSDTKILGGNTFGGSLVFTFNKVLNDPKSKACFIDTTPAGLYEVKTKIW

SEQ ID NO: 88 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 89 - protein, 1361 aa, Anaerococcus tetradius
MGNYYLGLDIGTNSVGWAVTDENYNIERFKKKNMWGIRLFDEAKTAESRRIHRQARRMRQRKIQRLNLLMELFDVEISKVDESFFIRKKESDLHYEDKSQDSRYALFNDKEFNDKDYHNKYPTIFHLIMDLIENDEKKDIRLLYLACHYLIKNRGHFIFEGQKFDVNSSLNNNINKLKSHLDQFYNICLDFDNDKLIEILVNQNLNISEKSKKIKELLRKTNLEVGIANLIAGGSIKLSNMFDDDELKNLDYNSLSFKNSNFDEGRELFEEVLEDRFELVEILKDIHDASVLETMLSSASISPDGGKYISSSMINSYNKHKRDLKLLKKIIKKYKKSEYDNIFRDENIKNNYLSYTRTGINKNKKVQAEDNTDSDGFYKYIVKILKDIKENDSDEDIKYILSEIDKKNFVPKQRTKENSVIPYQLREIELRKIIDNQSKYHKFLNEVDEKGISVKEKIISLLTFRIPYYIGPLNPSYNEEKNFTTSWVKRLAKGKVTPWNFEDMVDIDASREAFIENKLNKCSFLLDETVLPKDSLLYQEYMVLNELNNLKINGQSINTDLKKSIYEELFKKYKKVTRKRLISYIKEKENMSGDIVITGIDGDFKQGLKSYIAFKDIIGEKIDDDIYRKEVEKIIRDISLYGDDKSFIQKKIKNENKLDLSDDQISKIAKLKFKDWGRFSKKLLVGIKASDKNTGEIDNIIGFMRNYNYNIMQLMANVFTFKDEIEKLNSKYYTDEKINIDYLDDLYLSSPAKRMLWQSFQIVDEIKNIKNSDPKKIFIEMARSKEDKPTRKMSRKSRLEKLYTDSKKQFIKLFGPDEYDKLNNEIKNKSESDFRWDNLYLYYTQFGRCMYSLDPIDLEELSNKNLYDQDHIYPKSKIYDDSIENRVLVKKQLNLDKSNEYPIPDRVLNKDKNKLLAFWKMLNEKELIGDKKYARLIRKSPFTDEELGDFIARQLVETRQATKETANMLKRLCPDSKIVYVKAKNVSDFRRKFDILKCRSINDLHHAHDAYLNIVVGNVFDTKFTSNPLNFIKNNSKNRSYNLEKIYDYDVIRNEKIAWLAERKEENQDGSIATVLKNLSKNDIRVTRRTYIKCEDLFDENIVRKGNGKFPIKENNNKSDTNKYGGYSGIKNAYFVLLEDEKHNRILEAIPSFIYKKEKNGEKGSVINYLQNILGIKSAKILRDKIKIGSLLKIDKFPYNLAGKSGNGILISGGVQLILDKNTSKYIKKIENYKYKLDENKDYQINIFDKLSKEENIKLFDLFVDKFENSIYKNRVNIKLKEIKLARPKFEHLSIEEQIKTLTQMLILFGRENNAVNLEYIGLPKNTGKTKINKKINNKDIKIINQSITGLYETEEDLANI

SEQ ID NO: 90 - protein, 1377 aa, Lactobacillus brevis
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 91 - protein, 1239 aa, Lactobacillus buchneri
MTEKRKFDIREVYLAIHHIVKYRGNFLNSATVDSFKTSNIDFTSQFDRLNELYRQVILEEPFQINMNQVDKMTNKLLDNDALKLDTQKQVAKLLPVIYNDKPVDKQYTRLATEFSKAILGYKTKLDVILNLDTQNAKDWAIRLDDEDIDDKLPALVENLDESRQEIVTIIRDLYAQITLNAIVPKGKSLSESMVDKYNDHKDHLDLLMGLIHELGDDSAKGIKLREAYTQYVGKSGDKTLNQDDFYAAIKKNLDEDSKRSPKIQRLIEQASFMPKQRTSANGVIPHQLHQLELDRIIENQGRYYPFLKEPNSNTHKPNGGKYKLDELVAFRIPYYVGPLITKQDQEKTSGADFAWMIRKPGQGGEITPWNFDQEVDRMASANTFIRRMTTKDSYLVAEDVLPDSSLIYEKFKVLNELNMLKVNDRRLSISQKQDLFNNLFKKQKTIRTKKLQTYIRTKWELPSVMISGLSDPDKFNSSLATYIDFRDVFGEKVDDPNRQADYEKIIEWSTVFEDRKIYQAKLNQLDWLTESQSKALLTKHYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSPQDRPQRTFSRQRQLQSTYLNVAKALMKSNLNQELKSVIDSQQTLTDKLYLYFTQLGQDMYTGKEINFDELVNYQIDHILPQAFIKDDSLDNRVLVSAPINNAKSDNVPVKKFGAKMGYFWKQLAENHLISKRKLNNLTTDPDKIGKFTAQGFIHRQLVETSQVIRLVANILGNEYGHDGTTIIEVTAKMNHQMRKDFDLIKIRDVNDYHHAMDAYLTAYVGDYLYLRYPKLRSYFVYGDFKKLKDQSLKIRNFNFLHDLTNDEAGDKIVDQETGEIIWDKHESVKQLKKVYHYKFMLVSQEVYTRQDALFNQTIYPASDADKRKLIPIKNNKPVDVYGGYSGNVDAYMAIVRIHGKKEDKYKVVGVPMRAVADLKKAESKGRDNYLNAVHEVLKPQFTKKKKDRKTGEITEMMDDFDVLLGKVYYRQLIVDGNKKFMLGSSTYQYNAKQLVLSDKAMQVLSKDDKLKNQDENQNLIDVYDEILEKVDQYFELYDINKFRQKLHDGRKKFIELPVDNDFNGKKLISYGKRATIISILNGLHANATMSNLKYLGISSPFGMLQVPNGIILSPASRICYQSPTGLFERKVKLSDL

SEQ ID NO: 92 - protein, 1381 aa, Lactobacillus fermentum
MDYVKEYHIGLDIGTSSIGWAVTDSQFKLMRIKGKTAIGVRLFEEGKTAAERRTFRTTRRRLKRRKWRLHYLDKIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNAIVPNGMSISESMMDRYWTHERQLAEVKEYLATQPASARKEFDQVYNKYIGQVPKEKGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKAGDVASLVMAKTRGVNKPSVEGLSDPKKFNSNLATYLDLKSIMGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 93 - protein, 1306 aa, Sphingobacterium spiritivorum
MKHILGLDLGTNSIGWALIKQNFENKQGEILGMGSRIIPMGAELSKFEQGQAQTKNANRRIARGTRKLNKRYKQRRNKLIYILQGLGMLPDQIKLVNQFSDPNKLDKISILPISKNQQQLTAFDLLELRVKALTEKIELEELGKVIYKYNQLRGYSGGNSEPEKEENNEDESEENEKTNDSFVVFSKVLSLGLPEEITFKGKKLSKRKIAIETEDGIIEAETFLDSLKENDSLELHVNIRRAKSGDTITIKLPSKTSWRKKMENIEKQLADKSKELGREYFISELLFDILKENKWAKIRNNVILRSRYESEFDAVWSEQSKYYPILNHLETDRLQKILEFIFPGQKESQEKLRQTGLKEGLKYVIKNQVVFYQRELKDQSDLISNCRYEPTEKVVAKSHPVFQEYKIWEQINKLVINTKIENGVNRKGEIRYKYIDKPIPVALKEWLYEELQSKKEVSFNPILTKLKKEFKLRENVDFLNGMNAKDKLKGNETKVILQKALGELWNIFGLDDSERQVELWEILYNGKGNEYDLTSERTSNILAFIEKYSPDLENKNDVAIKISKIKFSRNYSNLSLKAIDNILPLVRAGKFFDQNFSEALSHKIVKLLNENVEDPFEKSAQEFLDKNQDVLSDGGIVNAIATILVYDKHTAKEYSGDELIKEFTQISRLKQGELRNPLAEQIINEALVIVRDIWRKYGFKPDEIRVELARELKNNAVERGKMYSANLKSQKHNAEIRNKLIELKQEISIANIEKYKLWVSQENLQEVYLKNYNDPSKSEIEKLKLWESQGHISPYTGQPISLSELFNRERYDVDHIIPQSRYFDDSLSNKVICEKSINNEKGNRTSMEYFEVGSVNYRIFTKDQFIDHANKYFSGKKRKNLLATSIPEDPIQRQIKDTQYISIRIREELNKIVGNENVKTTTGGITDYLRNHWGLTDKFKVLLKERYEAVLPKIAQLEYDNYKKETEKKFTEYKNADVEFNEPILDEEIFIEKFRSEFIRKKNNKLIIKGWSKRIDHRHHAMDALVIACTQPAHIKRLNDLNQVLKEWLDKNKEKFFPGFSGTKTELLDEVLNLEEEKRREIFNQLEKFRAIEMPWKGFPEEAEQKLKEVIVSHKPKDKLLLQYDIQGNKQIKLRGQLHEGTLYGLSNGKEIYRIPINKLAGKQFATEKTIEKIVNPFLKNVIEEHLKSFGKKEEAFSAEGILDLNKKLAERKDEQQNPKPHPPISTIKIYYKDPSKSKKKKTDDEDDISLQKLNRKKSFNDSLYVKTGDNYLFAVMEKEVFNKKLNKDKTERHYDLKLFLTLLIF

SEQ ID NO: 94 - protein, 1358 aa, Unknown
  Acidaminococcus sp.D21
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 95 - protein, 653 aa, Oribacterium sinus
MELINSEEFTFKEELEKHTQVAMKQLSEFTYEDLEDSYFSVPVKRMIWQTLLVVREIEKVMGYAPKRIFVEMTRTEEEKGDKGRKESRGNQLLELYKSIKNTDSHNWKEEIAAADKDGKLRSKKLFLYYMQMGRDMYTGEEIDLGRLYDDNLYDIDHIYPRHYVKDDSIMNNLVLVNRRANQDIKKDLYPIPEQIKANPNVHMLWDALHKQKLITDEKYARLTSNTAFSEKQLGDFIARQLVETGQGTKGVADLLEQLFKDTVIVYAKASNVSDFRRDNGFLKSRLVNDFHHAQDAYLNIVVGNVYYTKFTKNPWNFICKDYEKDKEKNRYNLARMFDWNVVRGSETAWIVERKDEKGTISTVRKMMQKNTPLLTRMNFEQHGSIANATLYSAKKAKSENYLPLKTADEKMSDVKKYGGYTSMSIAYYFIVHHKEDKKENVTIEALPLYCKDKVEREENGLEKYCEEVLGYGEVNIIRRKLKIQSLLEFNGYQVHLSGKTGNQLILRNAISLCLSTKWITYIKKLEKAVNIQIVEEVVTPEENIKLYNLLADKHANTVYSKRPNAYGEKLLADREIFVTLEFGKQCEALLQILSLTKIGSTEANLLLIGESEHSGKILISKNLKASDRPAVINQSPCGLYEKKEWIFDKIVEK

SEQ ID NO: 96 - protein, 1436 aa, Capnocytophaga gingivalis
MKYIKYILGLDIGSNSIGWALIQLDLLQKTKRIIAAGSRIIPMDQKVLSDFGKGITISPTAQRTSYRNARHCRERHLLRRERLHRVLHILGFLPTHYDKQIDFSKRYGKFVDNTEPKIAYNEGKFLFMDSFQEMLSDFKSHQPDLFYTKKNGEESKIPYDWTIYYLRKKALSQKISKEELAWIILNFNQKRGYYQLREEEGNKENDFEIISSKIISVIKKDKDKKYNKYWYDIILENGLVYQAAFYNDFVYNWINQDREFIIERTSLKNGAEKVKLSYLPTFDEIDKMDKKEQDKYYKKIKIKTENSIGNKTVGCYIYDHILQNPNEKIKGKLVRTIERKYYKEELKAILEKQIALQPELFTDQLLADCIRELYSKNEAQQRNLAARDFVHLLVEDIIFYQRPLRRQKSTLANCSLESRSYIDKDSHTRKEAPLKVCPKSNPYYQEFRVLQWLQNLKIYEIDSDQEVTHQFIKTLEDKQQLFEFLMAQKEIDCEELLKYFLNQTYPNAKEKALKSELKKWKDTYRWNYVYDIGEKSSKKYPMNETRYELKRHLEKVANLPDDFLSSEVEYLLWHLIYSVKDKVAYEKGLKKFAQKHHLDKDSFVESFKKFNPYPSEYGSFSEKAIRKLLPLMRFGAHWDFNHIDKNTQKRIEDLITGVENEEIRTILREKAEKYQLEKETDFQDLPLWLAQYIVYNRHAEASSLEKWTSVNDLETYLNEFKQHSLRNPIVEQVVMETLRVVRDIWQQYGQGQASFFNEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSKENKTIKIFTEEQYRTFIKEHYSNNPEKTKKLLLEEIPEKMVARQMNDTCYISKFISEILSKIVRSDEQDEGVHSKNVILCTGKITSILRQDWGLNDIWDNLILPRFERMNNLLQKEKFTIYSIEKQKKIPVVPINDQFKSFQKKRIDHRHHAMDAIIIACTTREHINYINNQHALEKEKDKKEKQEERDKLREKLCIKKYNNRSEGNYSWIFKKPWDTFTQEVRVALEDIVVSFKQNLRVINKATNYYERWVEENGKYIKKMVKQEGTNWAIRKPLHEETISGKIYLDREKITKNDILTATRKTVDSSFDDKRIKKITDTGIQKILLNYLKYKGSPEIAFSPEGLEELNKNLSIYNDGKPHKPIYKVRIYEKGSGRFALGEKGRKYKKYVQGASNLYFGIYQGAKRSFATIPLNEVIERQKQGLPSVPEYNEKGDLLLFSLSPNDLVYVPIEGEIIENIDFRNLSKEQKERIYNVNDFSSTCYFTPNRIAKAIFPKEVDLQRKGDKLSGSYDTKTASLEGIQIKEVCIKLKVDRLGNISKA

SEQ ID NO: 97 - protein, 1069 aa, Bacillus cereus
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLQVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 98 - protein, 1391 aa, Lactobacillus jensenii
MKEIKDYIIGLDIGTNSCGYVVTDKQNNILKLKGKTAIGARLFKEGEAAADRRAFRTTRRRLARRRWRLSLLEEIFDEEMNKVDPSFFRRLKESDYSPKDRRKQFNSIVFESSEADKAFYEKYPTIYHLRNALMHDNQKHDLREIFLAVHHIVKYRGNFLREDSVKAFKAAKFTLQGEDGIGPVDKLNDLLKEIYIEAAPELATDNLSKIEDIIKDKKLYKQDKLKQIANLLPKAVDSKDKAKLNKDIAKQVANALMGYMFRLDTLFSFTDVDVKDYKLKFSDANIDESLDALTSLLTDAQIEFVLELQSIYNTIVLNEIVPDGMSLSESMVKKYDDHKKDLKLYKEYIDSLSDQKKAKQLEAAYALYVNYRKADLLAAKKLFEKKKIGDKKFVDVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNFEEMVDTTESANQFIKRMTRKDTYLLAEDVLPKSSLIYQKFMILDELNRIKIDGKKLTSKLKHDIFEKLFKKQKSINLDNLKNYLLAEGNIPGLIEGLSDGINFNNSFSTYIDYRNIFGDEIDNPNKQADFEKMIEWSTVFEDRKIFKRKLKEITWLTPEQIKQVSSKRYSGWGRLSKKLLTQITDENGVNILQRLWNEPETLTEVLANPVIKRKISEANSLFVQINKVENILDDAYTSPQNKKAIRQVIRVVDDIIAAAHGKKPSQIAIEFARSSQNKAKVPDTRKKQLDKIYNKISSEILDSSIKNELKNLKSNKYLSKDKLFLYFKQMGRDAYTGDKLSLDQLQNYDIDHIFPRSFIKDDSLDNRVLTQKPINAKKSDYGIPALEFGNKYVPDLGITVKEMWKLWQENGLISKSKLINLCTNPKKIGSKRASGFINRQLVETSQVIKLVAIILQAEFPDTEIIEVKALQNTTLRESFHLYKNRSVNDYHHAIDAYLTTIVGNYLYQVYPKLRPYFVYGQFKKFNQEKNIDILKRLKNFNFLRQLIFNTDDNIYISGTKEIVFNKKDIIHKLETAYGYKYMNISRECYQETSSLFNQTLYAHNSSVKNSLIPKKKGLPTEIYGGYSGNKDSFFVLVKIVKKRTNLYRIVGIPTRELAKLNSSNNYNQALNKIVESKLCLKETESFKILIKRLLYGTLIVDNGQKFRIGSFKEKHNVQQLVLQLKSMKYIKFYIDGGQNYFTDVERKKLEKQDRDKCLLYVFDDIMNVVNKRFTLFDMSKYEKDGDSLREKFNCLDFNDKVSILSDLLKAFHANSDRTSITKLKITNLGRHQAGKNGITLTTNAQIIYQSPTGLFERRIKIKDL

SEQ ID NO: 99 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 100 - protein, 1362 aa, Lactobacillus paracasei
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 101 - protein, 1056 aa, Actinobacillus minor
MKALNYILGLDLGIASVGWAVVEIDQNELPIRLIDLGVRTFERAEVPKTGDSLALARRLARSSRRLVRRRAVRLLKAKRLLKQEGILQADDFHSSHLKPLPNNPWELRVKGLNHLLDRKEWAAVLLHLLKHRGYLSQRKNESKTDNKELGALLKGVSENRQLLQAQAFSTPAEIAIKKFQQEEGHIRNQRGAYSHTFDRNDLLAELRLLFQKQREFNNPYTSQSLEQAIAELLMWQKPALSGEAILKMLGKCTFEPSEYKAPKNSYSAEYFVWLTKLNNLRILENGADRGLTAEERQLLINQPFEKAKFTYAQARKLLELSDLAIFKGVRYGKDNAESATLMEMKAWHAIRKALESNGLKTEWNGLKTKPELLDKIGTAFSIYKTDEDISQYLNGELSPAVLNALLENLSFDKFIRLSLQSLAKILPLMEQGLRYDEACKQVYGDHYGKKEQLELRFLPKIPVEDIRNPVVLRTLSQARKVINGVVRLYGSPARIHIETGREVGKSFSERRDISKRQEENRNERQRAVEKFKEFFPHFVGEPKAKDILKMRLYEQQHGKCLYSGKELDLNRLLEKGYVEIDHALPFSRTWDDSFNNKVLVLASENQNKGNQTPYEWLNGKENAERWKLFQALVNGSRFPYSKKQRILTKYLDEDGFRERNLNDTRYVARFLCNFIEDNMQLVGQGKKRVFASNGQITALLRRSWGIQKVREDNDRHHAVDAVVVACSTRALQKKITDYVRYKEMNVFTGEKIDQETGEIIKFHFPEPWKFFRQEVEIRVFSETPAEDVVIALPDRPQANHEFIQPLFVSRAPTRKMTGQGHMETIKSAKRLAEGLSVSRVPLTQLKLKDLENMVNREREKALYEALKVRLEKFNNDPAKAFADPFYKKGGQQVKAVRVEQVQKSGVLVRQENGVADNASMVRVDVFIKGGKYFLVPIYTWQVAKGILPNRAATQGKEEEYWDIMDETAIFQFSLYQNDLIKLVTKKKTIFGYFNGLNRATSNINIKEHDLDKSKGKDGIYLEVGVKLALSLEKYQVDELGKNIQPCRSMKKRPPVR

SEQ ID NO: 102 - protein, 1081 aa, Neisseria flavescens
MTAFKPNPINYILGLDIGIASVGWAMVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELAVNKFEKESGHIRNQRGDYSHTFSRKDLQAELVLLFEKQKEFGNPHISDGLKEGIETLLMAQRPALSGDAVQKMLGYCTFEPTEPKAAKNTYTAERFIWLTKLNNLRILEQGSERPLTDTERATLIDMPYKNKLTYAKARELLGLDDTAFFKGLRYGKDNAESATLMEMKAYHAIRRALEKEGLKDKKSPLSLSPELQDEIGTAFSLFKTDEDITGRLKGCLQPEILDALLKHINFDKFVQISLKALRRIVPLMEQGKRYDEACAETYGDHYGEKNSEEMLYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKAIDIRRLNGKGYVEIDHALPFSRTWDDSFNNKVLVLGSENQNKGNRTPYEYLNGKDNSREWLEFKARVETSRFPHSKKQRVLLQKFDEKGFKERNLNDTRYVNRFLCQFVADHMQLTGKGKRRVFASNGQITNLLRGFWGLHKVRAENDRHHALDAVVVACSTVAMQQKITCFVRYKEMNAFDGKTVDKETGEVLHQKTHFPQPWEFFAQEVMIRVFGKPDGKPEFEEADTPEKLRALLAEKLSSRPEAVHEYVTPLFVSRAPNRKMSGAHKDTLRSAKRFVKHNEKISVKRVWLTEIKLADLENMVNYKNGREIELYEALKARLGAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLMQKYQIDELGKEIRPCRLKKRPPVR

SEQ ID NO: 103 - protein, 1392 aa, Gemella haemolysans
MANKTWYLGLDIGSASVGWAATDTGYKIIRKNKKRLWGVRLFEEAKTAEDRRGYRSSRRRLARRKWRLNLLEELFTSEVKKVDENFFLRLKESQYHYEDKTHKVPYAIFNDKDYTDKDYYKDYPTIYHLRSKLMTEENPDIRKVFLAIHHIIKNRGHFLLQGQSFKDGNLNNLIKELLELDILHVGFEVTEEVVDKIADISLEKKTSKDKLNDIKELYPKEKQLLEVFRLIFGGKTSLDKLFAIDEYKELDAAIKSVSFKEKIYEEVRHDYEQVLSNYIELLDLAKLVYDSIILSDIKKEGKTLSESKVELFEKHRDDLLKLKNLVKNDSKLSEDKKVELYALIFKEDKDKGTNYVNYIRKSEEGKGCNYEDFKKFLVKELAKLEESSVKTEIIKDLELEQFLPLQRTKDNSVVPYQIHKEELVKILDNAARYHSFLNEKDESGYNVREKVIQLLEFRIPYYVGPLNSSKKAKEGGFAWSVRNTGYENTPVTPWNYSKVIDESASAEKFITNLTNKCTYLKGEDVLPKSSLLYSEFALLNELNALKYDGNRISLEARNTIIEKLFKQQGKKVTKTSIKNLLKAEGYIDGKGEITGIDITVKNDLKSYRDFKKILGNKFNSEHVENIILWITLYGESRKLIKAKIESVYGEVYSKDEITKMSRLVYKDWGRFSRKLLTELVSKKLYNEETGECLNIIGAMRQNNILFMELLADRFDYSKQIVEFNKELQEDVTEIAPEILDDLYVSPAVKRSIWQTVRIVEELKKIIGCAPAKIFVETTRSNQEKKKPTDSRKKQLELAYKAVKKDVKELEKEIGTINFDVLNDRLSSVEPSKLKAKKLYLYYTQLGRCMYSEEPINISELFDNNKYDIDHIYPQSKIKDDSFTNTVLVKRESNAAKTDRYPLGSDIQTPSNRRFWKFLKEKGLISDEKYNRLVRTEEFSDEELSGFIARQLVETSQSVKAVASILGELNPETSICYSKAENVSSFRQNFGKIKKGDRDSKNNDQLIKVREINDYHHAKDAYLNVVVGNVYDTKFTRNVFNFIKDKKDGRKYSLNKVFYENVSDSKTVAWEMDKTIHQVEKVMNNNNIMVTRRTSEQKGGLFDATVYKAKVAAKAKDGVYYPLKTSNSVVKDVAKYGGYTSIGIAYYSIFEYTIVNKKGEEKITRIIPIPIYISQNIKDSTALIEFGKSQIFCRAYEKIKDFKLLYRKLCIGSKININNYQYYIGGKSDERFYYDSAIQVTLDKKSEKYLKILSKYQNWKKENKDGELWENITKENNIELYNKLVEKMNSEIFTKKKSNKYNELNSEEIRNNFIKISVEEQAKVLLEILNLLTNKKSIFDLKSIDIKAARGKISFNLTSLIQFSIIEQSITGFYEKEITIIGDKGNDMENNNS

SEQ ID NO: 104 - protein, 702 aa, Helicobacter pullorum
MRKILKIDERIQFKEVDYTAKNPENKKFVEFKNLKKFCEILGAIVGDRALADSIARDMTLIKDEEELAQKLRGYGKFSQEQITQLSALHFSHHISLSLKALSEILPFMREGMRYDEACQEAKLQAKHNDKKSKFLPPFCESIYADELTNPVVHRAIAEYRKILNALIAKYGSVHKIHIELTRDVGKNFQEREKYKKEIESNYKARVQAMQECEKLGLTLSEGNILKLRLFREQNEICVYSGRKITLANLKEQGALEIDHILPYSRSSDDSYMNKVLVFTNENQNKGNKTPYEAFGGDSQKWGEIESLALRSGYPKKKAKRILDKGFGDREAGFKSRNIVDSGYIARLIANYTKEYLKFLPLDSHENTALIAGEKDSKIHVEAVKGMLTATMRHFWGLGSKNRYEHTHHAVDAIIIAYINAAMIQRFSQFRQNQESLKARFYAKELAKEEFKTQRAFFEPFSGFREQVLAKVGQIFVSRPPRKRARGALHEETFYSIDDKKLSETYGGKKGVQRALSLGKIRQIGTKIVANGPMVRVDIFKHTQSGRFYAVPIYTMDFALGILPNKAVVSGKDKDRIIKDWLEMDSCYEFCFSLFKDDVIEVQKRDMEKPELAYFVSLDASDGRIKVRHHCNDITKINENQKKLFSEAIEKEVVGRGSIQNLKVFKKYKVSPLGEIKEAKYEPRQPIALKTSPKKHRKQNNAQ

SEQ ID NO: 105 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 106 - protein, 1007 aa, Helicobacter canadensis
MKVLGFDIGINSIGWAFVENNELKDCGVRLFTKAENPKTKESLALPRRNARSSRVRLRRRRSRLLSLKHIISKEFGLHYEDYIALDGNLPKAYTGKIESIYKLRYEALSQAISKEDLARVILHIAKHRGYMNKNQKTSQDSEKGAILSAIKENSNKIKHYQTAGEYFYKELFENLRDGTKEFKNIRNKAMKNEKTGNMESTYYNTILASDLEKELKLILEKQQAYHNYSDTFIKEVLEIAFYQRPLKDFSHLVGSCTFYENEKRACKNSYSAWEFIALGKIINTLESIKKDTGEIFSNEIITQILKEVLDKGSLSYTKLRKMINLDEKVKFKGLKYDKEGVEKTNLIEFKKLKEFKKALGEHNLERKTLDEIATHITLTKDENQLKKQLEQYALSQNQIDALAELDFNDHINLSFKALYEILPLMEKGKRYDEACNELGLKAKTSNQKSEFLPAFCDSIFAQELTNPIVNRAISEYRKVLNRLLKKYGKMHKIHIELARDAGLSKEARNKIEKEQKENKDINDKAEKTCKEFGLKPNAKNILKIKLWREQGEICAYSGKKITIDDLKEDKALEVDHIYPYSRSYDDSYNNKVLVFIKENQLKLNQTPYEAFGSNQEKWSKIQVLAQKLPYKKKNRILDENFKNKDQIEFISRNLNDTRYATSLIAKYTKEYLEFLPLSDDEDISLKSGEKGSKTHVQTMNGMLTSVLRHAWGFSQKDRNNHLHHALDAIIIAYSTNSIIKAFSDFKKNQEILKAKLYAKKLTSEEYKNQSKFTGFEKYRSKILEKLDSIFVSKPPNKNTKGALHEQTFYSYQDILEEYKTQEGLKRALECGKVRKIGTKYVVNDRMVRLDIFKKDNKFYGIPIYTMDFALGVLPNKVVTIGTDKDKIKKEWKTIDETYEFCFSLYKGDLVLIQKKEMQESEFAYYNGFDISSASISLEKHDNKFENLTENQKLLFPKAKEGDVEVRGIGIQGLKVFKKYMVTPLGEIQETRTEARQNIQPRKKHGLR

SEQ ID NO: 107 - protein, 1397 aa, Unknown
  gamma proteobacterium
MTKNYISPIAIDLGAKFTGVALYQYLEGADCTQEVAKGLLVDDRGNVTWSQEGRRGKRHQVRGYKRRKMAKRLLWLILDSEYGIKREEVTEPLLKFINGLLNRRGYTYISEEVDEESMNVSPLPFSEMMPDYFNSSAPLLEQLAKLLSDKNKLVRFRAEGKIPSNKNEFKKLLDTALDGKYKDEKKELSEAWGNILIASENVLKSTVDGHKSRSEYLANIKEDIKSNEELEKQISSKEIDGFYNLVGHLSNFQLRLLRKYFNDPNMSGVSYWDEKRLEKYFYQWVQGWHTKGGTDEAEKKNIILKTKGAPLLKTLKSLSADLTIPPYEDQNNRRPPKCQSVLLSDEKLTMHYPKWKEWVGQLVKQNDNAYLNENVTLANALHRIVERSRSIDPYQLRLLISITDAEKRNDLAGYKRLKLSLGSEVDEFLLLVKNIVDETKEAREGLWFETENKLFFKCGKTPPRKEKLKSTLLSAVLGKNLSDDEQSSFIEEFWKSGTPKIERRNVRGWCRLASQVQKTYGVYLKEYGLQQLHKLEAGKKLDDKPLALLYKNSGLIASKIGEALNIEPDEVSRFASPHSLAQIFNIIEGDVAGFNKTCRACTYENIWRMQEEKVESLLTNQLLSEIHGERKVPLKSAMCTRLSADSTRPFDGQMASIIEHIARKIAQHKIAQINDVPKEFSIDIPIIIESNQFSFTAELEEIKRGRGSAKAKKAKELGEKSKAGWVSKTERIKTSSEGICPYTGAPLGGSGEIDHIIPRSLTGRTKKTVFNSEANLIYCSSKGNHDKGNRVYVIEQLNDKYLKKQFSTSDVNLIKKKIKTTIQRFTEGGEKLRSFSELSREDQKAFRHALFVPELKSEVTSLLAVKNITRVNGTQAWLAKKIASLLAEHLDKQGRDYTLSAHQIDPWSVSKQRKMLASAEPIWAKKDPQPAASHVVDAVCTFLEALEQPHTASRLKTISSTSFEKTGWRSALIPDLIKVDALDRRPKYRRYNIGSTSLFKDGIYAERFLPILIDENGLMAGYDIDNSLKAKGADVVFESLSPFLLFKGEEVGAQSLSDWQERIDGRYLYMSIDKVKAFDYLQEKVGEKDIAAELLNSIHFTQRKTELRAKFSDDSGKKMKTLDAIRKSLKLTVTVNEIGKRKEKCGFSGTIGIPAKSAWENLLDEPLLETYWGTKMPPQEIWEKVYRKHFPRNIPNQAHRKVRKDFSLPVVDSVSGGFRVKRKTPNGYNYQLLAIDGYSAVGFKKEGDNVDFKSPALVPQIAESKSVTPISSELVHLDKNEIVYFDEWRKIDISDSDLKQFVSSLELAPGSQNRFYIRFTVDEDQFERHFKSALRVNGIQDLDTVNKTFDWNREIPSLLIPPRSNLFLLETGQKITFEYIANGANAEVKKAYSLRRA

SEQ ID NO: 108 - protein, 1082 aa, Neisseria meningitidis
MAAFKPNPINYILGLDIGIASVGWAMVEIDEEENPIRLIDLGVRVFERAEVPKTGDSLAMVRRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHISGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 109 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 110 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYIGPLSKGDASTFAWLKRQSEEPIRPWNLQETVDLDQSATAFIERMTNFDTYLSSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 111 - protein, 1426 aa, Capnocytophaga ochracea
MKNILGLDLGTTSIGFAHIVEDENKEKSEIKELGVRIVSLTTDEQSDFEKGKSITTNANRTLKHGARLNLDRYQQRRKYLIDLLQKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTTENKGSKESVRLQAYQWRAEAISKQLSKEEVAYVLTEINNNLNNASGYLGAISDRSKELYFNRQTVGQYLYAKLQENRHNSLKNKVFYRQDYLDEFERIWETQASFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIREKVKAIFQTLGICTKILYFDPLLPVKEFEEQDSYQLWHLLYSYESDDSTSGNETLYRILEKKYAFKREHARILANVALQDDYGSLSTKAIRKIYPNIKENQYSTACEKAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKEFGIKNPTKSDIIRYRLYQELEHNGYKELYTNAPIARDMLFSKNIEIEHIVPKARVFDDSFSNKTLTFHRINSDKGEYTAFDYITSLNSEEELNQYLTRVENAYKTKSISPTKYKNLLKKASEIGDDFINRDLRDTQYIAKKAKEILFQVTKNVLSTSGSITDRLREDWGLVDVMKELNMPKYQSLGLTEVEERKDGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNTNKPAGTDKQQITLTPRGQLHKETIYGKYQYYINKEEKIGVKFDERTIAKVSNPVYREALLKRLQANDNDPKKAFAGKNALSKNPIYLDESKTKTLPEKVNLTYLEEDFSIRKDISPDNFKDLKSIEKVIDQGVKRILIKRLQAYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFDAVVRAQQGIPIIDKTYKQAEGWQFLFTMKQNEMFVFPNATTGFNPAEIDLLDPKNKKLISPNLFRVQKIATKDYFFRHHLETNVETDNILKNVTWKREGLSGLKDIVKVRINHLGDIVSIGEY

SEQ ID NO: 112 - protein, 1424 aa, Unknown
  Parabacteroides sp.D13
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYRSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 113 - protein, 1395 aa, Lactobacillus jensenii
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 114 - protein, 1140 aa, Roseburia intestinalis
MRENGSDERRRNMDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRTGCSWSEKGYILTPRNKAENYQHTMLRAMLVEEVKEIFSSQRRLGNEKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTAHKPYGEWKVMEDKDFLFSLYSRDLIHIKSKKDIPIKMVNGGMEGIKETYAYYIGADISAANIQGIAHDSRYKFRGLGIQSLDVLEKCQIDVLGHVSVVRSEKRMGFS

SEQ ID NO: 115 - protein, 992 aa, Treponema vincentii
MQKNSGEDENCGFEFLTEEEKELIKPLFFRISKPSFQFADIEKKLKGKNGFWKFNYRKDTNVSGCPVSAGLKNIFGDEASAESWKDKKVGQYDMCDIWHVLFDFDDEEKLLEFAKRKLFLSDEAAKKFCAIRIQQGYANLSLKAIRKITPFLRKGYIYSTAVFLANIPFMIGRDIFLQNEKEIEDSVKNIIGTLRDKNNIIVLANRCIESAFKDKDNDFRFEEWDKALVENSAWDLFGKKKWNEYDEEKRKTIISQVSEKVEDNLKIAVGKNPNDYKYPLLRTDDLIMDYLNQKGFVVKGELYHPSDTDYNFETPVPAEDGKIYLASPRSPSVKNPVVMRALHQLRKLVNYLIKTGKIDSTTKINVELANDVNDKNQRKAIEELAKTNEKNNADARKKIEELCNEAGFKVVPTESDIKKFRLWKEQNETCPYTGKHISFTDLFGPIPKFDFEHTIPRSLSYDDSLENLTLCDSEFNRNIKKQRLPSELPDFEEINKRFLKFYEDKIDNCLRIIELNSKSGGSYEEPAVKDLRIVKKHKAQYELNYYKEKLRRFSSTEITSGFKHSQLNDTRIITKFSLSYLKGVFDHVQPVKGSMTDTFKRQWGLMERNEIKDRSNHTHHTVDALTVACINRGKFNLLSEAIKNSSDGKHLKFPKPWETFDTDVLNAVRYIIPKYFSDESSLRQSKKILRGRDGKPVLKNGKAVFIQGATARGSLHKDTFYGCIKTVPEKGGKSEMIFVQRIPVSTLDEKVAEKIIDKRIRKTFEKNLSTGIQTLQEIQTDGILLPFKKEGRDVFVKRVRIKAHPTSPIILKKHHNVINKNPKDYKQNYYVENEENYLLAIYRGKDAKGKDVSDHKLCNLLNAVKSRQNKTGFYPDFKEKKGINLQLYKVLKIGKIVILQNDIQEDVFALPKEKLWKRMYRIAGLATSRNDIQIKLVHIIRETPWGYMKGEKDLNAGKECLLYGTANFKGLVEGQDFTVSPAGEIIQKARVC

SEQ ID NO: 116 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 117 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 118 - protein, 1234 aa, Prevotella tannerae
MPNFWSIFTENLQTYLMKTRILGLDTGTNSLGWAVVDRDENNQYTPICRGDLIFTEGVKQEKGIEFSLAAERTSYRASRRHYFRRRLRKVEVLKVLVKHKLCPPLSDEALNRWHTKKEYPLDEDFILWQRTNEADNKNPYHDRHICLHRKLNLKDSQTDRYTLGRALYHLTQRRGFLSNRLDQNEEAEETGKVKSAISELSKEMKEAGCEFLGDYFYLLYRTEGNRVRIRSRYTDREKHYLQEFKEICRVQELDEDLAKALEKTIFFQRPLKSQRQGVGKCTMEKGHSRCAVSHPLYEEYRLLCYLNNIRIKTPSDDRLRPLNAEEREKITPLFYKEKNFDFEKIAKKLAGKTPFGWIRDAEDWPYQFNYRMTQEAPACPTTAQLIKVFGEDWKAALAETYTMSAKQDGTLKTEDEICTDIWNVLYSFSSKEKLKEFGLKKLQLDEVQAKAFSEIRLTRDFASLSLKAIRKILFFLRTGEDYSKAIFLANIPTIVGEEIWNDIERRSRLLYKVDLALRPQEERDAEEHRTIAERIKAAVAAEVPDAPIDLLYHPSMIEAYPDAKRNERFDCYQLGSPKTNAVRNPMAMRSLHMVRKVINHLLRKHIIDEKTEIHIEYARELNDANKRQAIADWQRELSKRHTAYAQNIRQLYKAETGLVIEPTKADILKYQLWEEQQHVCLYTGKKIGIADFLGANPKFDIEHTIPRSRGGDSTQENLTLCESKFNRDIKRDKLPTELANYEEILARIEHWKKQCYALKLKRDGIRTHSGLEKSIKDSRIRRRHLVGLEYGYLKGKYDRFTMKEVPEGFSRRQGAGIGLISKYAGLFLKSLFKDPKNPNRSNVYVVKGAITAEFRKLWGLQQADEAKSRENHTHHCIDAYTIACIGPCEYAALAAYYRSDEEFKYGRRREKPQFEKPWPTFTEDLLKLQEELLIVHQTTDKLGKRDRRKVKTPRGKFLTGGDSARGRLHQETYYGAINYDGNIKYVVRKPLDSLTEKDLDKIVDETVMGIVKGAVEAKGSLKEALADGIYMNKEKGILIKRVRIFSDVSEPINLKQLRDVSTKEYKRHIHLRKDENYLFAIYEGIDKKKNKKQTETATVDYLDAAKFYKDSKRRDKANSLVGDYSKKNKLPLKCILKKRQMVLFYEHSPEEIRFKDKKDLSRRLYIVTSIAKDGRVKFLHHQAATATGIQSSPSPFTNDGEHQPYYRLSASNIKVLVAGIDFDINILGEITPKL

SEQ ID NO: 119 - protein, 1496 aa, Prevotella veroralis
MKTILGLDLGTNSIGWAKVCVDDNGNYLRDIKLGSRIIPMSQDVLGNFDKGVTESQTSVRTGFRGVRRIRERSLLRRERLHRVLHVLGYLPPHYDSAIGWNKNEPSTYGKFLNHGEPKLAWEHKEDGSMRFLFMESFHEMMADFAKSQPSLVSDGKKIPLDWTIYYLRKKALSQPIRKEELAWLLLNFNQKRGYYQLRGEEDDDNPTKCEEYYELKVVGIEADEEGKNGNTWYNVKLENGWIYRRQSKIPLDDWIGKVREFIVTTEYEKDGITLKKDKNGDVKRSFRSPSEDDWGLRKKRTEKLLDSSKMTVGAFVYDHLLAEPSDKIRGKFIRTIERKYYKKELYAILCEQSKYHEELRSGDYLNKCAEELYKNNQPHRNSLLTKDLAYLLLEDLIFYQRPLKTKKSLIAECPYEAYKYVDKETGEIKRQGIKCIAKSNPYYQEFRLWQFISNLRLFNKADDKEVTADYLPTQDDYVRLFAYLNDRKEINQETLLKEFFKLKKITVNSEKVFPIRWNYIEDKEKKYPCNETRHELLLALDRARIDHSWLEKPGQEYRLWHLLYSVESKEETKEALRKLKDDDAFVESFLKVKPFKREYGAYSEKAIKKLLAVMRMGSLWRETDICDTTKGNITKILQGEIDEKLKEKISASVSSYNQLSDFQGLPVWLACYVVYGRHSEAAEIQHWKTPESLLAYINGFKQHSLRNPIVEQCILETLRTVHDIWKEVGHIDEIHVELGRNMKSTADQRARISENVLRNENTNLRIKSLLLELKNDPNIKDVRPYSPMQQEKLRIYEEGVLQELTKDDKDFTEITKISTMAQPSAKELQRYKLWLEQKYRSPYTGKSISLTKLFTSAYQIEHVIPQSRYFDDSFSNKVICESEVNSLKDNMLGYEFIKNHGGEIIHCTMLGDVKVLSESEYKAFVNDHYAHNKRKRENLLLEDIPQEFLNRQMNDSRYISKVVKALLSNIVRAEGEEEATSKFVVSCSGGITDRLKKDWGLNDVWNKIVYPRFERLNRLTGTEAFGQWENKDGKRVFQTAVPLELQRGFNKKRIDHRHHAMDALVIACTSRNIINYLNNESANNPKKREDLRQKLCDKNRTIRKPWETFTQDATAALEDVIVSFKNYVRIINKATNYYERYDVEGKKVIAEQRGDDMWAIRKPMHEATYYGRVNLRRKKKVNLRVALENISSICDNKLRIYINGLVEKGFNTKQILDKFKNTNDHFSMQKIDKVEIWQFTNEEEKLVATRKPLDTSFDTKKIASITDTGIQTILLNYLETKGGDSTIAFTPEGIVEMNQNISKYNNGKEHMPILKVRLYTKLGKKIPVGQTGCKAKQFVIAEAGTNLYFAIYEDEEGKRSYRTIPLNEVVERLKQGLSPVPEKNDKDVHLKFYLSPNDLVYVPIEDEHESLAKDHIYKFVDSSGTTANFIPHRSANVIFELNKKDAEKFCSGSIIQNEYGVGSSQSKNQKAITGEMIKAVCRKLEVDRLGNVIKVI

SEQ ID NO: 120 - protein, 1082 aa, Neisseria cinerea
MAAFKPNPMNYILGLDIGIASVGWAIVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNTHALQTGDFRTPAELALNKFEKESGHIRNQRGDYSHTFNRKDLQAELNLLFEKQKEFGNPHVSDGLKEGIETLLMTQRPALSGDAVQKMLGHCTFEPTEPKAAKNTYTAERFVWLTKLNNLRILEQGSERPLTDTERATLMDEPYRKSKLTYAQARKLLDLDDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGNRYDEACTEIYGDHYGKKNTEEKIYLPPIPADEIRNPVVLRALSQARKVINGVVRRYGSPARIHIETAREVGKSFKDRKEIEKRQEENRKDREKSAAKFREYFPNFVGEPKSKDILKLRLYEQQHGKCLYSGKEINLGRLNEKGYVEIDHALPFSRTWDDSFNNKVLALGSENQNKGNQTPYEYFNGKDNSREWQEFKARVETSRFPRSKKQRILLQKFDEDGFKERNLNDTRYINRFLCQFVADHMLLTGKGKRRVFASNGQITNLLRGFWGLRKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHKYVTPLFISRAPNRKMSGQGHMETVKSAKRLDEGISVLRVPLTQLKLKDLEKMVNREREPKLYEALKARLEAHKDDPAKAFAEPFYKYDKAGNRTQQVKAVRVEQVQKTGVWVHNHNGIADNATIVRVDVFEKGGKYYLVPIYSWQVAKGILPDRAVVQGKDEEDWTVMDDSFEFKFVLYANDLIKLTAKKNEFLGYFVSLNRATGAIDIRTHDTDSTKGKNGIFQSVGVKTALSFQKYQIDELGKEIRPCRLKKRPPVR

SEQ ID NO: 121 - protein, 1512 aa, Fibrobacter succinogenes
MKKILGLDLGTNSIGWAVVNADEITRDDGSRYLKPNGISAAGSRIIPMSADILGDFEKGNSISQTAERTRMRMARRLHERALLRRERLLRVLNLLDFLPKHFADKIDRYGKFTDDSEPKLAWRKNTEGKYEFIFQDAFNEMLAEFKDKQPEIVEEGKKIPYDWTIYYLRKKALEKALSKEELSWILLQFNQKRGYYQLRGEEEEIPQDKKIEYLAQKVVKVEATDQKKGDDVWYNVYLENGMIYRRTSKAPLDWEGKVKEFIVTTEVENDGETPKKDKEGNIKRSFRAPKEDDWTLLKKKTEADIENSHKTVGCYIYDSLLNNPKQKIIGKLVRTVERKFYKEELTQILKKQVELIPELRDDNLYKQCIEELYPINEAHRNTIAKTDFANLFINDILFYQRPLKSKKSQIDNCPYEERIFIDSKTGEKKKVPVKCIAKSNPLFQEFRLWQFIQNLRIYQREKEIDGKLLTDIDITSECLKSEEDYVRLFDWLNDRETIEQEDLLKHLFNTKKSKNKENPYRWNYVEDKVYPCNETRATILKGFSKCGINASVLSPELEMALWHILYSVEDKKEIETALTHFAQKQGWNDDFAKVFSKAKPFKKDYGSYSEKAIKKLLSLMRMGKYWNQDNIDKNTLDRIDKIINGEYDEKISNRVRDNAINLKDISDFRGLPVWLACYIVYDRHSEAKDCTKWNSPEEIDSYLKKFKQHSLRNPIVEQVVTETLRTVRDIWIQEEQIDEIHLELGRDLKNPADKRKKMSENILKNENTNLRIKAMLMEFMNPSMGIENVRPYSPSQQDILRIYEENALDNLTKDDKDFDFISKISKQAQPSKTDIIRYKCWLEQKYRSPYTGKTISLSKLFTPAYEIEHVIPQSLYFDDSFSNKVICEAEVNKLKDRQLGYKFIAEHHGEKVQLSQGEVVEILSVDAYEKFVKENYANNRIKMKKLLMESIPDEFIERQLNDSRYISKVVKGLLSNIVREKIDDENYEPEAVSKNLISCNGAITDRLKKDWGMNDVWNSIILPRFIRMNQITGKDCFTTTNAEGHLIPQMPLELQKGFNKKRIDHRHHAMDAIVIACTTRDHVNLLNNEAAHSKFNATRYQLQRKLRRFEKAVIDGKEREVAKEFLKPWDSFSSDSKNILENIIVSFKQNQRVINKTTNAFLHFDENGKKTFIKQGKGDSWAIRKSMHKDTVFGEINLRKVRSVSLNEAIKVPERVLNKKIKEKILELKNNKIDAKNIKKYIEENHTGGYGIDSSKIDVFYFTKETKERFFATRKTLDTSFNQAKIKDSIADSGIQKILLAHLKSKNGDAEQAFSPDGIDEMNKNIVELNNGKFHQPILKVRVYEKADKFAVGQKGNKKVKFVEAAKGTNLFFAIFEKDGKRSYLTIPLNVMIDCQKQYGNQWKNNIEAYLKEKELVEKDVKLQFILSPNDLVYLPTEGSIDKKRIYKVVSFTNNRLYAIPYAIAKSIVDKNEFTQLNKIEFTDNKESIKDACVPVIIDRLGNVIEFNGKRL

SEQ ID NO: 122 - protein, 1259 aa, Streptobacillus moniliformis
MKYILGLDLGVASIGWAVTEINEKGEPVGLIDANSVIFKPLDNDKGKLYNVERRDKRGSRRILRRKKHRVERTKMLLVNSSFLTNEEIDNLYVGKLDNIYEVRLKGLKEQLSKNEIARLMIYYCKNRGFKSNRKTEDLEILKSLGEKISEKDSDEKKLKPIIAKNTELIESKGLTPIEVIYMIRENDNSILGFKNKEGNYKFGFKRNQVIDEVRKILGTQQILSKEIVDEYIDILSSQRDFSDGPGGDSKYKIDYTKLAGKCKYTGEVRAVKSAPSYEIFTMLQKLNDIRYVKFTSEDKIEKKKLSKEVIHKLYDLVVEKNKTLTYDLIEKSIDEENIKLLNIPKLSKSKYVELRKSYFKERNDNENLTEEEINAFNEKLNNERMKQELIRNNLKAYKELKSKFKKNNIDENRIKELGGIYFLDLVAELLTYSKTDEKLEYFVENVERYSLFKEQRDIVEIIKTFPNYTKNGNLSLSLVRELNKLLMEGHDYESSLSSLNYYIDTDVDWEKFPTISEIEDSLSTKITNPNVKHILVILRKLYNTLLFKYGRPEKVHLELSRDFSNDFSTRNKIQKEQLENKVRREVAAFEMYGANKDIVAGKDRLSNDDFVRIKLWEEQNKVCMYSGRTIEKYQLTSAEVQIDHILPYSKSFDNSYSNKVLVFSNENQDKKERTPYQWLKGTEKWNEFKQRVRLNLNISNKKKENLLFEDEVVNNEFLERELHATSYSSRLALNIFQRLIPVSDEDKYDEHGNEKVKYLYNRNVIAFQGKMTSMLRNLYSLNKYTHSFESDTLDIDNKAFILKEFEINKDNLKMTAYNVNTGLEITSETKVEKNKSGEFKTIKDELLKKELDKKENLIEISDYFKDKVLFDLKIVDFEEIDTVEPEIISILYKMITALKEEVYSKNRENHLHHSLDAFLLTIMNRSMQMKLIKYNQLISVLKNKEIEIFNEEKGEYIDSKEFAEELQKQKIIDIDGNERGIKFNVNGKTHRLNLVKPYENFLDDIKNKIFDKRENNKLPYHVVKSKVSGALHAETILGESKGEITKRISVFDINYKNLGKIFDKDGSQKEIYETLVKWLEAKSKDYPKLKNGNIIKKVKIVDGNKDKLIKLGNKRYVEMGRTTVKILVLKKEAEEGLKFASIGRYKYNLLKSEKDVNISIWKDAIHFCKVRYNKLKENGYRLIHELIPGETIELELNKGNISKCLVVGFSGGKIEISSVIGDALDLINDKISTRIKERYYITVSTIKSIKKINKNILGD

SEQ ID NO: 123 - protein, 1091 aa, Mobiluncus mulieris
MDSRKYRVGIDVGTNSVGFAAVEEDDSGSPTRFLNTMVVIHDSGVDPEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 124 - protein, 872 aa, Candidatus Parvarchaeum
MLGSSRYLRYNLTSFEGKEPFLIMGYYKEYNKELSSKAQKEFNDQISEFNSYYKLGIDLGDKTGIAIVKGNKIILAKTLIDLHSQKLDKRREARRNRRTRLSRKKRLARLRSWVMRQKVGNQRLPDPYKIMHDNKYWSIYNKSNSANKKNWIDLLIHSNSLSADDFVRGLTIIFRKRGYLAFKYLSRLSDKEFEKYIDNLKPPISKYEYDEDLEELSSRVENGEIEEKKFEGLKNKLDKIDKESKDFQVKQREEVKKELEDLVDLFAKSVDNKIDKARWKRELNNLLDKKVRKIRFDNRFILKCKIKGCNKNTPKKEKVRDFELKMVLNNARSDYQISDEDLNSFRNEVINIFQKKENLKKGELKGVTIEDLRKQLNKTFNKAKIKKGIREQIRSIVFEKISGRSKFCKEHLKEFSEKPAPSDRINYGVNSAREQHDFRVLNFIDKKIFKDKLIDPSKLRYITIESPEPETEKLEKGQISEKSFETLKEKLAKETGGIDIYTGEKLKKDFEIEHIFPRARMGPSIRENEVASNLETNKEKADRTPWEWFGQDEKRWSEFEKRVTSLYSKKKISERKREILLNKSNEYPGLNPTELSRIPSTLSDFVESIRKMFVKYGYEEPQTLVQKGKPIIQVVRGRDTQALRWRWHALDSNIIPEKDRKSSFNHAEDAVIAACMPPYYLRQKIFREEAKIKRKVSNKEKEVTRPDMPTKKIAPNWSEFMKTRNEPVIEVIGKVKPSWKNSIMDQTFYKYLLKPFKDNLIKIPNVKNTYKWIGVNGQTDSLSLPSKVLSISNKKVDSSTVLLVHDKKGGKRNWVPKSIGGLLVYITPKDGPKRIVQVKPATQGLLIYRNEDGRVDAVREFINPVIEMYNNG

SEQ ID NO: 125 - protein, 1229 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDIREIYLAVHHIIKYRGNFLNGTPMRSFKVENIELNTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKGIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRHLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIEREKKVVAPETGEILWSNVAPNETIKQIKKVYNYKFMIVSREITTRRAELFNQTVYPKNYRGKLIPIKEDRPTDLYGGYSGNTDAYLAIVALEDKKKGKYFKVVGIPTRAAAKLEKLKQQDSQQYLQALHEVIAPQFTKSTKKGIKKTEFEIVLDKVHYRQLVQDGPVKMMLGSSTYKYNAKQLVLSEKAL

SEQ ID NO: 126 - protein, 1398 aa, Veillonella parvula
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYNDQDYFKEYPTVYHLRSELMKSGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKIVEGLSDSKDKEYILSQIELQILLPLQRIKDNGVIPYQLHLEELKAILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKVVKEHLIEAVFKQDHKKMTKNRIEQFLKDNGYISETHKHEITGLDGEIKNDLASYRDMVRILGDGFDRSMAEEIITDITIFGESKKMLRETLRKKFASCLDDEAIKKLTKLRYRDWGRLSQKLLNGIEGCDKAGDGTPETIIILMRNFSYNLMELLGDKFSFMERIQEINAKLTEGQIVNPHDIIDDLALSPAVKRAVWQALRIVDEVAHIKKALPARIFVEVTRSNKNEKKKKDSRQKRLSDLYAAIKKDDVLLNGLNNEIFGELKSSLAKYDDAALRSKKLYLYYTQMGRCAYTGEIIELSLLNTDNYDIDHIYPRSLTKDDSFDNLVLCKRTANAQKSDAYPISEEIQKTQKPFWTFLKQQGLISERKYERLTRITPLTADDLSGFIARQLVETNQSVKAATTLLRRLYPGVDVVFVKAENVTDFRHDNNFIKVRSLNHHHHAKDAYLNIVVGNVYHERFTRNFRAFFKKNGANRTYNLAKMFNYDVNCTNAKDGKAWDVKTSMDTVKKMMDSNDVRVTKRLLEQTGALADATIYKATVAGKAKDGAYIGMKTKSSVFADVSKYGGMTKIKNAYSIIVQYTGKKGEVIKEIVPLPIYLTNRNTTDQDLINYVASIIPQAKDISIIYGKLCINQLVKVNGFYYYLGGKTNSKFCIDNAIQVIVSNEWIPYLKVLEKFNNMRKDNKDLKANVVSTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 127 - protein, 1485 aa, Prevotella bivia
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSFRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGIIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHALSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEYFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDIICNRKLKKYIKARLNEGLQKKQILNIFKELNNVWEGIDVNKIDIWEMSNDKEPMVATRKQLDTSFDEKKIRSISDTGIQKILLNYLITKNNNPELAFTPEGIQEMNSNISEYNDHKKHQPIYKVRVTEPLGAKYPIGTMGNNPKKFVEAQAGTNLYFAIYEDKEGKRNYDTIPLNIAAERLNQQLSPVPETNENNTPLKFYLSPNDLVYVPSEEERHSGNNIQLDKNRIYKMVSSTSKRCFFIHHRVAISLVDKKEFSAQNKMERSIDNEQVMIKSVCWKLITDRLGNIIKVIK

SEQ ID NO: 128 - protein, 1218 aa, Prevotella buccalis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYHEQGNKVRIRQRYTDRKKHYQHEFDAICEKQELSSELIEDLQRAIFFQLPLKSQRHGVGRCTFERGKPRCADSHPDYEEFRMLCFVNNIQVKGPHDLELRPLTYEEREKIEHLFFRKSKPNFDFEDIAKELAGKKNYAWIHDKEERAYKFNYRMTQGVPGCPTTAQLKSIFGDDWKTGIAETYTLIQKKNGSKSLQEMVDDVWNVLYSFSSVEKLKEFAHHKLQLDEENAEKFAKIKLSHSFAALSLKAIRKFLPFLRKGMYYTHASFFANIPTIVGKEIWNNEQSRKYIMENVGELVFNYQPKHRDVQGTIEMLIKDFLANNFELPAGATDKLYHPSMIETYPHALRNEFGILQLGSPRTNAIRNPMAMRSLHVLRRVVNQLLKESIIDENTEVHVEYARELNDANKRRAIADRQKEQDKQHKKYGDEIRKLYKEETGKDIEPTQTDVLKFQLWEEQNHYCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYHMEETFRQGRGSKPKFSKPWATFTEDVLNIYKNLLVVHDTPNNMPKHTKKYVQTSKGKVLAQGDTARGSLHLDTYYGAIERDGEIRYVVRRPLSSFTNPKELENIVDETVKRTIKEAIADKNFKQAIAEPIYMNEDKGILIKKVRCFANSVKQPINIRQHRDLSKKEYKQQYHVMNENNYLLAIYEGLVKNKVVREFEIVSYIEAAKYYKRSQDRNIFSSIVPTHSTKYGLPLKTKLLMGQQVLMFEENPDEIQVDNTKDLVKRLYKVVGIEKDGRIKFKHHQEARKEGLTIYSTPYKNNDDYVPIFRQSIKNINILVDGIDFNIDILGKVTLKE

SEQ ID NO: 129 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 130 - protein, 1487 aa, Prevotella timonensis
MKNILGLDLGSNSVGWALVKVEENGNPIGSIKMGSRIIPMSQDILGSFEKGDTVSQTAQRTLYRGKRRLIERHVLRRERLCRVLHIMNFLPAHFDRLLGWDKTDNKTYGKFIDDSEPKLAWRQNKNEMGKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKKKSDIPLYDWVGKTLQLIVVTTYEKDGKTPKIFDSGKQNPSYRLPKEDDWGLVKKRTESQLQSSGKTVGAFIYDNILSKPDDKIRGNLVRTIERKYYKKELIEILQQQAKYHDELHNQNLLESCAKELYAHNDVHYNEVIKSNMINLLVNDIIFYQRPLKSKKSLIANCKYESYEYVDKETGEIKEMPIKCIAKSNPYYQEFRLWQFIHNLRLSDVVTREDVTAQYLSTPQDYCNLFTYLNDRKEIKQDILLKDFFKIKKVQIDKEKVFPIEWNYIKDATKSYPCNETRYELLSALKRAGMDKQWLDDTPNMQYRLWHLLYSVEEKEESAKALRKLYDDDKFVTSFLKIKPFNKCYGAYSEKAIKRLLTLMRMGKAWNEQAIDAKTLKCIQQIITDNVDSKLKEKIDDSRYVLHHVSDFQGLPTYLASYVIYGRHSEVTDIQCWDSPEDLLKFIRDFKQHSLRNPIVEQVILETLRVVYDIWKAEKHIDEIHVEVAREMKLTAQQRNEANLRNLNNEATNLRIKYLLEELKNDTFIKDVRPLSPIHQEKMRIYEQAVLGNLNKQDKDYDDIIKISKKEHPTNAELIRYKLWLEQRYCSPYTGKAISLSKLFTTAYEIEHIIPQSRYFDNSFNNKVICEAEVNKAKGNMLGYEFIKKQGGQKIYCTQLGKAVTILKEEAYKQFVNEHYAHNKRKRDNLLAENIPESFSSRQLNDTRYITKTIMSLLSNVVRQQSEEEATAKNLLPSSGSVTDRLKNDWGLKDVWNTIVTPRFERLNKLSGTNDFGEMKEENGNRYFQTNVPLEYEKGFKKKRIDHRHHAMDALVIACTTRNMVNYISNANANSPKQREDLRQLLCDKNRIINKPWDTFTQDALKALNDIVVSFKNNVRIINRATNRYQRYDKNGKKIIFSQKGDDMWAIRKSMHKETVFGRVNLIRKEVLPIAKALDNISAICNAQLRAYVNDLVDKHFNKKQLVAHFKSLNYKWNRQDVSKVEVWISSDNKTPMVAVRKPLDTSFDKKKIASITDTGIQTILLNYLESKGGDASVAFAPEGIQEMNSNIELYNNGKAHKPIKNVRLSEPLGAKYQVGERGAKTKKYVEADKGTNLFFAIYEDEEGKRYYYSVPLREAIERQKQKLSPVPEYNEKGVALKFYLSPNDLVYVPTEEERTMGTCHIDKARIYKMVSSTGCSCYFVPSTFAKVIVDKVELQSLNKMEKAITDECIKEVCWKLKVDRLGNIINVIK

SEQ ID NO: 131 - protein, 1138 aa, Bifidobacterium dentium
MLCRCHRRYRIGIDVGLMSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 132 - protein, 587 aa, Neisseria subflava
MATSRSRIRSQTDAFGVVGSLVAFNQTSRLFVAKKNEGETADKELGALLKGVADNAHALQTGNFRTPAELALNKFEKESGHIRNQRGDYSHTFNRKDLQAELNLLFEKQKEFGNPHVSDGLKEGIETLLMAQRPALSGDAVQKMLGYCTFEPTEPKAAKNTYTAGRFIWLTKLNNLRILEQGSERPLTTTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYIEIDHALPFSRTWDDSFNNKVLVLGSENQNKGNQTPYEYFNGKDNSREWQEFKARVETSRFPRSKKQRILLQKFDEDGIYRIGVKTALSFPKYQIDELGKEIRPCRLKKRPPVR

SEQ ID NO: 133 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 134 - protein, 1354 aa, Prevotella melaninogenica
MADFAKYQPGMVADGRKIPLDWTLYYLRKKALTQAIRKEELAWILLNFNQKRGYYQLRGEEEEENSTKHEEYYELKVVSVEAAEEGKGGNTWYNVTLENGWIYRRQSKIELNDWVGKVRPFIVTTEYEIDGVTIKKDKNGEVKRSFRAPSENDWGLRKKRTESLLEESGKTVGAFIYNHILSEPADKIRGNFIRTIERKFYKKELEAILREQSKHQKELKDIDTLIACIKELYPNNKPHQDSLIKKDMTYLLITDLIFYQRPLKSKKSLIADCPYEYYEYVIKETGENKRQSIKCIAKSNPYYQEFRLWQFIINLRLFDRNNDKEVTSEYLSSMEDYTRLFTYLNDRKDINQETLLKDFFKQKKVKRGMEKEFPIRWNYIEDKEKKYPCNETRHELLTALGKVGIDHSWLDDKELFYRLWHLLYSVESKEEAEGALRKLVDNDDFVNAFLKIKPFKKEYGAYSEKAIKKLLAVMRMGNLWNEVDICEQTRDRIQNIIKGDIDEKIKDRMGRTFSQLSDFQGLPEWLACYVVYGQHSEATDIQRWTKPENLMAYINGFKQHSLRNPIVEQCILETLRTVHDIWKEAGHIDEIHIELGRGMKSTADQRARMSKSIMQNENTNLRIKSLLMELKNAKEFENVRPYSPMQQEILRIYEEGALQELTKEDAQYNEISKISQMAQPSANELLKYRLWLEQKYCSPYTGKPISLSKLFTSAYQIEHIIPQSRYFDDSFTNKVICEAEVNQLKSNMLGYEFIKKHGGEIVRCTMIGDVKLLDAKEYYNFVTEHYTNNRRKKEKLLMEDIPQEFLNRQMNDSRYISKKVMAILSNIVREEDEQEAKSKFVIACSGGITDRLKQDWGLNDVWNSIVYPRFERLNKLTNTENFGRWENKKGKQVFQTSVPLELQKDFSKKRIDHRHHAMDALVIACASNNIINYLNNESAKSQEKREDLRKKLCDKNRIIRKPWETFTQDAHTALENVVVSFKNYIRVINKATNYYEKYDKNGKKEIAEQKGQDMWAIRKPMHKETVFGQVNLRRKITIKLKDALEKIPAICDKELRDYINILVAKQFNKKQILAHFKSINYRLNMKSVDKVDVWQFSNEKEPMVATRKSVDTSFDTKRIATITDTGIQKILLNYLKAKNNDPNIAFTPEGIAEMNKHITEYNNGKQHQPILKVRVSEPKGAKYQVGETGNKRSKFVEAQKGTNLYFAIYEDKEGNRSYNTIPLNEVIERLKQGLSPVPDANEKSIPLKFHLSPNDLVYVPKTDEENEIKMGQIYKFVDSSGTTANFVPHRVSNLIYNVDKKIAENFCNHEIIQNEYGIGSPQSKNQKSITGEMIKAVCWKLEVDRLGNIHKIIK

SEQ ID NO: 135 - protein, 1130 aa, Streptococcus gallolyticus
MTNGKILGLDIGIASVGVGIIEAKTGKVVHANSRLFSAANAENNAERRGFRGSRRLNRRKKHRVKRVRDLFEKYEIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIRHNLPNQFTEGQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKISVIRGQFTSQLRRKWKIDKSRETYHHHAVDALIIAASSQLKLWEKQDNPMFVDYGNNQVVDKQTGEILSVSDDEYKELVFQPPYQGFVNMISSKGFEDEILFSYQVDSKYNRKVSDATIYSTRKAKIGKDKKEETYVLGKIKDIYSQNGFDTFIKKYNKDKTQFLMYQKDPLTWENVIEVILRDYPTTKKSEDGKNDVKCNPFEEYRRENGLVCKYSKKGKGTPIKSLKYYDKKLGNCIDITPEGSKNEVVLQSLNPWRADVYFNPETLKYELLGLKYSDLSFEKGTGKYHISQEKYDVIKEKEGIGKKSEFKFTLYRNDLILIKDTASGEQEIYRFLSRTMPNVKHYAELKPYDKEKFDNVQELVEALGEADKVGRCIKGLNKSNLSIYKVRTDVLGNKYFVKKEGDKPKLDFKNNKK

SEQ ID NO: 136 - protein, 1371 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 137 - protein, 1168 aa, Unknown
  Azospirillum sp.B510
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 138 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 139 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 140 - protein, 765 aa, Butyrivibrio fibrisolvens
MGITIGLDLGVASVGWAVVNDDYEILESCSNIFPSADASKNSERRGFRQGRRLTRRRKNRIHDFQKLWEDKGFVIPSQGTEDVLAIKIKGLSEKLSVDEVYWVLLNSLKHRGISYLDDADSGDNSSDYAKSISRNEEELKEKLPCEIQWERLQKYGAYRGNISIVEDGEPITLRNVFTTSAYKKEVEQFIDTQAKYNAQYSGDFKADYLEIFNRKREYYEGPGNELSRTDYGKYTTEINADGEYITVDNIFDKLVGKCSVNPDERRAAGASYTAQEFNVLNDLNNLTISSESSFIEDGKLTEDAKRKIIETIKNAKTVNVKKIICDVIGDKKCQISGARIDKNEKEIFHSFEAYNKMRRALEEIGFDISSLSRENLDLIGDILTLNTDRESILNAFNRKGIELADEAKDILVKVRKTNGSLFNKWQSFGLSIMNELIPELYAQPKNQMELLTAMGVFKSRGDRFLECKEIPGDLIVDDIYNPVVSKTVRITVRILNALIKKYGYPDRVVIEMPRDKNSDEEQQRLKKEQRDNENEIKDIKARVKTEYGREITEEDFRQHSKLSLKLKLWNEQQGICPYSGKSIKIDDLLDNPNLFEVDHIIPLSISFDDSRNNKVLVYSSENQDKGNRTPLAYLASVNRQWDIHSFMDYVLKTYAGAQKRKKRDNLLNEQDITKVEVLQGFVNRNINDTRYASKVVLNSLQEYFSSKECSTKVKVIRGSFTHQMRVNLKLKKTVMNHMFIMQLMQCLLLFHRWDMTLIMNLQISI

SEQ ID NO: 141 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 142 - protein, 1035 aa, Candidatus Puniceispirillum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 143 - protein, 1270 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 144 - protein, 1204 aa, Prevotella ruminicola
MERILGIDTGTNSLGWAIVDKDENQYHLVAKGTNIFSEGVKIEKGIESSKAAERTEHRSVRKHYWRRKIRKIRLLTILSDNDLCPRLKHEQLRQWRLKKVYPTDDTFMEWQRTEDKAQVNPYKFRYICLTQKLDLSDITQRFILGRALYHLNQRRGFLSNRKEATKESEGTVKEGISSLSKDMKDSGCEYLGEYFYQLYQQGKKIRNHYTARKEHYLKEFKAICSKQELDDALIEKLEKAIFDQRPLKSQKGQVGTCTFEKGKSRCPSSHPLYEDFRMYSFINNIKVQVDTLYDKGERSLTDEEKQLIIPLFKRKSKRTFPFEDIAKKIAGKNNYCYIKSNEEKAYKFNYQMDTQVSGSPVNAQLEEIFGEDWLSSVCEVYTLANNKSRFQIMNDVWHVLFFYDDEDKLKEFAKDRLQLDDELAEKFSKISIPNDYAALSLKAIRKIMPYLRDYGLIYSEAVFLANLVDVLPQHVWGIKEMREAAIENVIDVMHSYDKNNIDGITLEGCVKTFLKERYQVSDDNLKKLYHPSMLDPYPRQRPNDEGVFQLGSPRISSVKNPMAMHSLFRLRKVVNLMLKKGYITPDTKVHIEFSRDLNDANKRWAIQTWQRENEKERERCRKEIEKYIASPSDTDILKYQLWEEQNHKCLYTGDEIRITDFLGDNPKYDIEHTIPRSAGGDSTKMNLTLCSSRFNRDEKKTKLPAELVNHDEILERISNWKEKYEDIDKQIRKISTKGATSKEDKDSKIRRRHYLILQRDYWRGKYQRFTMTEVPEGFSRRQGTDISVISRYARMYLKSVFKQVYIVKGIATSDFRKMWGIQDEYAKKERVNHVHHCIDAITIACIGKAEYDKLADYRHQYDDYLFQGKTKPTFDKPWPSFVIDIKHIQDELLIAHYAKDNLEKFTKKNLRGKDGRIIRDKFGNKLQMKGDTSRNSLHNDKFYGAINHEGEIKYVYRTNIEALDAKSIGNIVDPTVRSIIESAIAIHGSLKAAINKGIWMNEEKHIPIKKVRVFRNDVKKPIELKDQRDLSDKDYKQHYYVTNDGNYMMLIFSKLNNKGREIRQHVVINSLEATEVIKSHKRSQVGKVVWESYYSKEGFDLIYKLKSGTMILLYENNRDEVWDLDIRNLQKRLYIITKMKYDGRIYMMHHQEAREKKDLEEKSGSFKINEDYRPLIVNSYNQFNALVQDLDFEINDLGEIRRLI

SEQ ID NO: 145 - protein, 1178 aa, Scardovia inopinata
MGKRHNSNMAKKKISYRIGIDVGLNSTGLAAIEVDDDGAPIRILNTMSVIHDGGVDPDAAKVRGTRLAISGIARRTRRMRRRRAKRLDRLEQILEKYGYTDTEPVLEEPYGPWICRAELADGFINDDEQRRMMIGIAIRHIARHRGWRNPYQNVRALLNIDDSDLSEEYKNLKEKVQDQINDGKDLPNFTPSQLVRDYLDNFSGQPAARIRTGKAGPRGNRRDAVGILPQRMRQSDYAYELQRIFDMQKIGRDEAQELLMAVFEAKSPKGSAEKRIGKDPLTGKKRALKASLAFQKYRIVATITNLRIKTGTGSERMLSPTELNDIYTYLLRVQDDNHLPTWEDICEEVLHIGRYQLAGIGKTFEGGERISNMPPVIQTSLAIHGLSEGTLAEKLTKWWDKADDDSRESMIKLLSNTVDIDRVNEVDENFASALDFIDSLDDEELTKLDKIALPRGRAAYSEEALNKLTADMLNTGDDLFSARQRIYHVNNSWRPPQPPIGEPLGNPAVDRVLKITNRYLMNCLNRWGQPRRVTIEHTRSGFTSVKQATEHQKISDKRAEYRRDIVKQLEEAGVESVHEYDIRRWEAVQRQNGQCLYCGRDITFKTCEMDHIVPRKGPGSTNTRTNFAAVCPECNRMKSNIPFASWAETKEAKDRGVSLDKAIKQVRFFNFTKNEYSPQAQRNFKKSMIERLKQKTSDEPLDNRSIESVSWMADELYKRIDWYFNHEQYETSKKAINDDKDNLSGTQVVVYPGSITAEARNAAGLGGNIHFIGGRYKTRLDRRHHAVDACVIAMMEPGIARILTERNQLRQAQRLTARIEDDEVNWKDYPTENTAGYNKYQAWSDRMHALLEYMNNALDYDKIPVVRWERLQLGNRSAHEDTIHPLKKLPLSHEISAIDINHASTPALYEALVSLPDFSEQDGLPADPSRQINVNGERYSGDDLVSFFNSNAAQIAIQGGSAELGTAFHHARIYRCWTVGKNGKKKIFFGMIRVYQHDLLHAKNEDLFTYPLKRSSVSMRYAKKEVVHAILSGNAEYVGYLCVGDELVLDLKGDKSNDEGGSRLSGQVGEFVQKFEEDSKVNSQIVNRWTVDGFPDEAKLRLRPSMFAGEGLKNMKSELVENAAIKNILSKTGWRVSVDVISKKSPVVLRRNAFGEPRWKTNAGLPVSYRWQDTETKE

SEQ ID NO: 146 - protein, 1371 aa, Gordonibacter pamelaeae
MNLRNVESYQVGLDIGTGSVGWAVLDDNGDLCRFKGKPTWGSRVFPTAETAAEARVHRGQRRRYDRRRQRIDLLQRFFADEVAKVDPEFFIRLNQARLHPENRDPAHADYRWPLFNGSNFTEKDYYRQFPTIYHLRAHLLKSDEPADIRLVYLALHNIVKHRGNFLHQDNPSLSARNANVGDAVEALCLALDEWCGAHDVECACDEAALAEALGDASLRPGEKRERAEAALGVEKAHKKLAKAVSSAVVGYAAEFGHVFFAESEGSKFALSNDEKVEAYVCPDEGRDLFDAMRAVHSSYVLMGILSEAQGELLSVCKVGEYERYKRDLETLKSLVRAYGPERYDEFFCGPFYEGTRDYDPGKAQGYTKYNLGASKLSHEDFLKEVQKLLKDIGAQADERYADIERAIEAGAFLRRLKTSDNGTIPYQLHLEEMDAIIERQAAFYPFLAQEKDKLKSLVSFRIPYYVGPLTQKNAARDGKGEARFAWSSRKPGMEDARVYPWNWEDVIDKDQSAEDFIRRMTGTCTYLKGEPVLARCSLDYELFCVLNELAGARWTQDGDKSYRFDAADRLGIVEDLFKKRKRVTYEAAEKWLARTHGPESGKSAGGAYHVSGGQGEDAFESQLSSHYDFCKILGVDELSDADEAMAEDIILWNTVFEDRSILKRKIKLAYGDRLGDAQVRKLCQKRYTGWGRLSGELLRGLRSATDNGPKTIMDILLEGDPNHARRMGAAMNLMEILHDDLLEFQAKIDEHNRERALAVGGMSVDEVTGSPALRRGINQALRVVDEIAGIAGKPPAHIYVEVTRDEGARNKGRRTTSRYRALEAALSSIKAQCADVYAELKERDPRALDDERLTLYFMQCGKCMYSGDALDINKLQTYQVDHILPQSYVKDDSFENKVLVRPDTNQRKGDTLLLDERLIARMRGFWRTLRDAELIGEKKFNNLTRTSVSDEQMKKFVSRQLVETGQMVKQVQQLLQARYPESEVQPVKAGVSHQLRVGCALAKSREINDFHHAHDAYLACQVGRFVQYRHSAVYSEPVKMAAVVKQFIKKQAEDYRRTRELPGSDGFIVSSFMTPGFDVKTGEVFRDAWDAGAEIDRIRRCFDYKDCFISRMPEETHGAFWDATIYSPRAAGKTLSLPLKRGLDPRKYGSYSREQFAYFFVYEAVKPKKKQRVLEFAPVPVRVASALANDPDALEDYARELAEAEGLVFERIRRRKVYKYQQIIVGDSRLYVTGREEVRNARQLAFSQDETKLICRIEQGEECEEGELLDLFRSMQRKYLACAPRLARLMKVAEMEEGFIAATASGKREVLLSLTSIAAAHRNSIDLKPIGRKGSSGQMKITFSKELSTNGILFVDSSVTGMFERRCRLGL

SEQ ID NO: 147 - protein, 1388 aa, Zunongwangia profunda
MKRILGLDLGTNSIGWALVNEAENEKEISKIIKLGVRVNPLTIDEKTNFEKGRPLSTNADRTLKRGARRNLQRYKLRRENLIEILIDNHIITKETPLTEIGKGTTYQTLSLRAKAVRERIDLEDFAKVLLAINKKRGYKSSRKASNDEEGQAIDGMAIAKELYERGITPGQYVLELLENDRKYIPDFYRSDLKQEFNKIWNNQKTFYPEILTDELFKELDGKNKSQTWAICQKPFNIKGIKRITKGREKTIENYHWRVKGLSGKLNLEKLAIILQEINNDINQSSGYLGGISDKSKKLYLNKETVGEFLYKQIAKNPHTSLKNQVFYRHDYLDEFEQIWKTQSNFNANLTDELKQEIRDVIIFYQRKIKSQKSLISFCQFESWEQEYFDKETGKTKTRTVGRRVIPKSSPLFQEFKIWQNLNHLVFTNSETDEKIEIKEVEQEIRKELFEELNLRGDLNPNDLLKILRSQFKIGKLSNWKCNFEKIEGNRTNAALFNIYQKISDFEGYGIDWNKSNAKKIRKELKATFPEIGIDASILEFDAYKKQLTNQSSYELWHLLYSAEEDFKISEQDKLIYGNSSVSLKKKLHLKFGFNPEYAKMLANLSLMSDYGNLSAKAIKKILPYLEDGHLYSEACRLAGYNHSKSLTAEELEKFEPKAKLDLLKKNSLRNPVVEKILNQMVNVVNQVIDTYGKPDGVRIELARELKKSAKERAEMTKGIADGTRRNEEIKKIITQKFGIPNPTKSDLVRYRLWQELESRGYKDIFTDKYISPDKIFSSEIDIEHIIPKALLFDDSFSNKTLSFRNVNLKKANRTALDFITQDYQSNVEAYKERVETWNKDNHISKGKRNKLLMSLKDIPDGFIERDLRNSQYIARKAKRMLYEVFPNEVLATSGSITDKLRSDWDLINVMKELNLPKYKALGLTEYEERLDKGTEELFKHEVIKDWTKRNDHRHHAMDALAVAFTTHNHIQYINNLNARKDITQDNHPIIKNIENLITEVNSKGKRVFKAPMSSFRESAKEQIEAILVSFKNKNKVVTKNINQTKKEGGFNYQNAKTPRGQLHKETIYGKSKQPLEKPVKINNRFCKKQVGLIINFKEQEAVLHHLKKYDNNEKIAFSNKTLKSDPIQVNGSPLREVKIFEEIFTIRKDINPDNFKTQKHLDKIIDKGIKEVMKKRLEEYNGDFKTAFSDLDKNPIWLNQSKGITIKRATISGVTNAEPLHQAKDHLGNIILDDNGKEIPIDYVSTGNNHHVAIYQDESGNLQEEVVSFYEAVIRKNQDQPIIKKRHPKGWKFLFTMKQNEMFVFSSENFNPSEIDLLDEKNAAIISPNLFRVQKIATKNYMFRHHLETEVTNNLDFTYRHFQATEWLRNLCKVRIDHIGRIVQIGEY

SEQ ID NO: 148 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 149 - protein, 1186 aa, Gardnerella vaginalis
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFTPWIFRAKLADEYIADEKQRKQMLSVAIRHIARHRGWRNPYQSIKSMTQETEYSEFYNELLKNIEKFAPGVSCEGSTPAQLVRDYLLSQQGKASRRLRITTDDRRKNHPNSLDPVLPRKLMQSDNMLEILNIFNVQHIDNKYVREQIINAVFYAKSPRGSAENRVGKDAITGKGKRALKASLAFQKYRIISTISNLRIRENSKERCLTIEEKQSVYKLLTTSTDEYSKEKSAEAPLYTWIDVADCLGIERYKLRGVGSQIEDGESVGNRPPMLNSELAILYANAKSLKQSLITWWLAANRTQEDKEAFIEILSNTVDIEAIHDNPEYQDKYGSVIAFIDSMDETEIAALENISLPNGRAAYSLETLDKLNKQMLETDDDLFEARKKLFNLPNNWRPSEAPIAEPTGNPSVDRVLKIVHRFLISAKNRWGNPERINIEHVRSGFQSKKMANSYKKLLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEESTYCKNHDISVDSAINRVRAFIFPPNSYDKRGASQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLELLNEEMRADRIAVVNSIRLRYSNSSVHKDDVHALLKLHVGDEIDSETIRRASTPALYCALTRNPDYDVNNGLPENTDRTILLHDKKLNADDSITFFKSKAAQLFVREGSVEIGNSIHHLRIYEYFEKLKSGKVKKSYGMIRVFQDDLHRYIHEDLFSCDLPEQSISMRYADTKVAHAVQTGNANYLGYLVPGDEIIVDFSHVKLSGYIGEFVEFLNKIGANCAAYKHWVVAGTDDKTTLILKPSMISSEGIDKLYSNCERNNFDYASYEKSIDKILVDKGWRVSVNVLDQYKAATIRRNALGEPRWASRSHLPISWSWDTGENRE

SEQ ID NO: 150 - protein, 1434 aa, Bacteroidetes oral
MKNILGLDLGTNSIGWAYVKQAQNDSEKSEIAELGVRVNPLTVDEKTNFEKGKPISTNADRTLKRGARRNLQRYKLRRQELIELLKDYQVISDKTILAEDGKETTFETLRLRVKSAKEQVSLEELARILLMINKKRGYKSSRKAKNEDEGQLIDGMEIARRLYDENLTTGQLSLQLLKEGKKSLPDYYRSDLQHELDKVWNFQKQFHPDILTDEFYTSIQGKGQKATRESFSSKYGIDTAENKGSREEKKLQAYQWRADATHKELTKEELAFVITEINNNINNSSGYLGAISDRSKELIFANETVGEYLWKQIQNDPHTSLKNQVFYRQDYFDEFERIWETQSGFYPQILTESLKNELRDILIFYQRKLKSQKALVSICEFESKEIPLKDKQGNPISKNGIPVTKLVGPKVAPKSSPLFQEFKIWQNLNNVLVRPKGSRKRKVTTNQQSTLLEGQEPVFELNLEQKELLFEELNLKGNLKTDYCLELIGYSAKEWEMNYPTLEGNKTNKALYEAYLKIIDSEGYDAKKLLKVKTDKDDINLDDIKVSASEIKTMISDIFNELGINTKILDFDAELERKQFEAQASYRLWHLLYSYEGDDSKSGNELLYRLLEDKFGFKREHSKTLANVSLLSDYGNLSTKAIRTIYPYIKENKFSTACELAGYRHSKLSISKEENENRTLKDTLDVLKKNSLRQPVVEKILNQMINLINELIEKHSEKDEKGNIVKYFKFDEIHIELARELKKNAEERRELDSKVREGKDRNEKIITILKSEFGLPYPTKNDITRYRLYEELKDNGYKDLYTNTYIPREKLFSKEIDIEHIIPKSRLFNDSFSNKTICYRQDNLNKGERTAYDYIEGLGKTQLDEYLNRVENLYTNKFITKAKYRNLLKKESEIGDGFIERDLRETQYIAKKAKEMLLQITRHVVSTTGSITDRLRDDWELVNVMRELNLPKYKVLGLTEIQERKNGQTVEVITDWTKRNDHRHHAMDALTVAFTKHSHIQYLNFLNARKDEKHKEYSNIMGIQQLETEKTTDKDGKDRRVFKTPIPNFRQVAKEHLESILISHKTKNKVVTRATNKIAGSKKQQETLSPRGQLHKETVYGKYRRYVQKEEKIGSKFDLQTIERVANPLYKRLLTKRLEENGGDPKKAFTGKNALAKSPIYLDETQTQQLPEKVKLVWLETDFSIRKDITPDNFKDEKSIDKVLDEGIKRILKDRLKSFDGDAKRAFTDLEQNPIWLNKEKGIAIKRVTISGVSNAEPLHTKKDHLGNEIFDDTGKPIPVDYVSTGNNHHIAIYRDENGNLQEKAVSFFEAVTRANQGLPTVDKTYNQHLGWQFLFTMKQNEMFVFPNKETGFDPQEIDLLDPKNKKLISPNLFRVQKISTKNYFFRHHLETSVETHNALNGVTYKSQLGLNGITDIIKVRINHLGDIVHIGEY

SEQ ID NO: 151 - protein, 1341 aa, Unknown
  Peptoniphilus sp. oral taxon 386 str. F0131
MWGSRLFEEASTAQDRREHRSNRRRLERRKYRLDLLEELFVEEINKIDPEFFIRLRESKFHFEDRSLKNTFILFNDKMEGGYNDKVFFSKYPTIYHLRSALINGNKEDVRAVFLAIHNILKNRGHFLLAGNDINISLSLNDTLTDLFEYLKIHLGIEVEFENKLKDIEKIALDKNLSKSDKQKKIVQLLETDYKKQLADVFKLSLGLTANMENIFGKENEQGLEFINAENKIKKIQFDSSYEENIAEFDQFYGEYFEIIDICKKIYDAISLSQILVDGKGLSESKVLSYEKHKEDLKLLKKVLKNIDKAYDNKGEDRLVYKVLKEDKDKGTNYVNYSKLSNNGTATTKEEFYKFLSKNLDLKKFGKLNKEDIETLDYINSEILLGRFLPLQKEKINGVIPYQLQMKELTQILNNASKYLPFLNKIEDGMTVKDKIISLIKFRIPYYVGPLNEYNRIENGNGFAWIEKKKNEKIFPWNFNDVVDIEKSAEKFINNLTNKCTYIKEETVLPKNSIIYSKFMVLNELNNLQYGNKKLDIELKMKMYTDLFLEKKDNRKVTEKRILEYFRINGINDGKEKLTGLNNEIHADMKSYRDMCEIMGENFNINVAENIINWITVFHGEKKILINKIKNVYGKMFNDEQISKLSKLNYSDWGRLSKKLLTDIKCYIDADGINFPVSILEAMEVSNKNLMELLSNKYEFISCIDDINNKYFGDRDISASELIDELYVSPAVKRGIWQSVRILEEIVSIIGHNPKKIFIEMTRHNEEKVQKSSRRHNLEELYKAIRKDPEYVELIKEFDSTTDTDSFKIKKLYLYFMQLGKCAYSKEKIDFDKLFTDSYDIDHIYPRSKTKDDSIHNNLVLVKAKYNREKTDVYPIDINIQKNMNSFWNFLYTKKFITEEKYKRLIRTSDLTDEELAKFISRQLVETSQSTKATAEVLKQIYGDSDICYVKAENVSDFRYGSSRQKDKNDIQKLFVKCREVNHFHHAKDAYLNIVVGNVYDVKFTKNPVNFIKKNKMGNKSNYSLNHMFCFDVERNGYKAWDSSETIKTVGRMMKSNDVRITKHVHPTRGELYDATIYKAKIAKTGSYMPLKSSKNTPLSDVTKYGGYTKIKIAYYSVYKYKFSDKNLIKTEIRLIPIPIYLSKNDDDIKEYVKNYLNDRVNSKLIDFTKIYDKLYVNSLIKINGYLYYLGGKTNDRVWIDNAVSIVLDDKIEYLIKRISNDIKYGYEINVSDDELMDIYESLAEKANKKIFYNRLSDFEKIFSNMDVKKKFVKLEKNDKCRVLLQLLNVLTDSQTTYKLEMVGLKHSRSNIGMKISNLEEFKVINSSITGLYSNEIDILNI

SEQ ID NO: 152 - protein, 1391 aa, Lactobacillus gasseri
MTKIKNEYIVGLDVGTNSCGWVAMDFQNTILRMHGKTAIGSHLFDAGNSAADRRAFRTTRRRIKRRKWRLKLLEEIFDPYMTEVDPYFFARLKESGLSPLDKRKNVSSIVFPTALEDKKFYCNYPTIYHLRYDLMSEDKKFDLREIYLAIHHIVKYRGNFLYNTPVKDFEASKIDVKDSLEKLNELYERLDSEFTVELDSSNALEIEKIIRDKKVFKINKVKSIHQLLSLKTENKERTKLIKDVSKQIINAILGYKTKFETILLKNISKDEADDWEFKLTDVDADNKFENLIGDLNENEQEILLEIRNLANAITLSNIVEEGKTLSESMIDKYNKHSDDLELLKQVISDHPDRDKAKKLALAYDLYVNNRHGKLLQAKDVLGSKKTLSKEDFYKEVKKNLDDSKASQEILDTIALDSFMPKQRTNENGVIPYQLHQLELDRIIKNQGKYYPFLKEVNPVSSHLKEAPYKLDELIRFRVPYYVGPLISPNESTKNKQTKKNQNFAWMIRKEQGQITPWNFDQKVDRMASANKFIKRMTTKDTYLLGEDVLPANSLLYQKFTVLNELNNIKINGKRISVPLKEELYNNLFKKNSTVTTNKLKSYLKENYNLINVEIKGLADEKKFNSGLTTYNKLRNLKIFDQQLDDLNYDKDFERIIEWSTIFEDKAIYKDKLKTIKWLSDRQIDKLSKIRMQGWGQLSKKLLSQLTDNNGQTIIEQLWDSQNNFMQIVNQSDFKDAIAVANQNLLVNTSVEDILNEAYTSPANKKAIRQVVKVVDDIVKAASGKVPKQIAIEFTRDADDKAKISQTRANKLRKVYKELSNELASETIRNELERVAKDQKLLKDKYYLYFMQLGRDAYTGEPINIDDLGQYDIDHILPQSFIKDDSLENRVLVKKAVNNGKSDNVPVKLYGNRMAADLGMTIRHMWEKWKDQGLITKTKYNNLIIDPDKINKYESSGFIHRQLVETSQIIKLVSTILQSKYPDTEIIVVKARYNHYLRKHLNLYKSREVNDYHHAIDAYLSAICGNLLYQVYPYLRPFFVYGQYKKFSSDPKKEKIIYDKTRKYNFISQIFENKSNDIISLETKKKVFDKKDIIEKLKHAYNYKYMLVSRETETHDQEMFKMTVYPRLSRDTKKSRNLISKKKDMPTEIYGGYTNNSDAYMVIARINKKKGTEYRVFGVPMRELVNLRKAEKNGRYNAYLKQVLEPEIMYSKNGKKNKTISSFEIVKAKVPYKQVILDGDKKFMLASSTYVQNAKQLTLSQNSMQAITDNCENDTEEEKALEEKALIEAYDEILTNIDKYLPLFDINKFREKLHAGREKFINLSLDVKKDTILQVLNGLHDNAVMPKIKSLGLSTPLGFMQFSSGVPLSENAKLIYQSPTGLFEKRVKISDL

SEQ ID NO: 153 - protein, 1426 aa, Sphingobacterium spiritivorum
MKHILGLDLGTNSIGWALIKQDFENKQGEILGMGSRIIPMSQDILGDFGKGNSVSQTAERTKYRSVRRLRERFLLRRERLHRILNVLGFLPEHYASQIDFTKRFGKFKEETEPKLVYSNEGFIFKKSFEEMLSDFKTHQPQLLEDNKKIPYDWTIYYLRKKALSRKIEKEELAWILLNFNQKRGYYQLRGEEEEENPNKLIEFYSLKIVDVLADEPQKGKSDIWYSLILENGWIYRRSSKTPLFDWKEKTRDFIVTIDLNDDGSVKTDKEGNEKRSFRAPGENDWTLVKKKTEQEIDSSRKTVGTYIYETLLKNPKQKIKGKLVRTIERKFYKTELKQILEKQKEFHPELRQDDLYSDCVRELYKNNEAHQLTLSKKDFVHLFMEDIIFYQRPLGSQKSSISNCTLEFRKYKDENGTEHTQYLKAIPKSNPYYQEFRIWQWMYNLNIYKKEDDTNVTKDFLNTKADFESLFEFLNNRKEVDQKALLKHFKLNDKTHRWNYVEDKKYPCNETKTMILSRLDKVENISDDFLTREMEQKIWHIIYSVNDKVEYEKALKSFAGKNNLEDNSFFEAFKKFPPFKSEYGAFSEKAIKKLLPLMRMGKFWNYNNISEQSKSRIQKIITGEYDENIKDKVREKAIHLTTETDFQGLQLWLVQYIVYGRHSEAAMLGKWNSADDLEEFLKEFKQHSLRNPIVEQVITETLRVVKDIWQKYGNGAKDFFREIHIELGREMKLPAEERERLTRQISENENTNFRIKALLAEMMDDNSVENVRPFSPMQQEILKIYEEGVLNSDIEIEDDILKISKTAQPSSSDLKRYKLWLEQKYKSPYTGQIIPLNKLFTPEYEIEHIIPQSRYFDDSFTNKIICESAVNKLKDNYIGLEFIKKLGGSIVECGNGKSVAILKHDAYEDFIKKHYANNRSKRNKLLLEDIPEKMIERQMNDTRYISKYISGVLSNIVRVEDGTDEGVNSKNIVPGNGKITTQLKQDWGLNDVWNDLILPRFERMNHLTNSTDFTAWNENHQKFLPTVPVEFSKGFSKKRIDHRHHALDALVIACATKDHVNLLNNQSAKSDTKRYDLKKKLMKFEKVAYNHPQTGERIEREAPKQFLKPWETFTIDAKNHLETIIVSFKQNLRVINKATNYYEKYVEKEGTKVKERVEQKGTNWAIRKPMHKETVSGKIDLPRIKVPKGKILTATRKSLDTSFNLKTIGSITDTGIQKILKNYLQYKDNNPELAFSPEGIEDMNKNIEKFNNGKAHQSISKVRVFELGSKFPLGQSGNKKEKYVEAAKGTNLFFAIYQDKNGKRSYETIPLNEVIERQKQGLSVVDLKGVDDFYLSPNDLVYVPSEDELENISMIDFNKMSSERIYKVVSFTGNQIFFVRQDIATSVVNKAEFSTLNKMERAIDGTMIKETCVKLQIDRLGNISKI

SEQ ID NO: 154 - protein, 1361 aa, Lactobacillus casei; identical to SEQ ID NO: 70

SEQ ID NO: 155 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKLAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 156 - protein, 1517 aa, Unknown
  Bacteroides sp. 20 3
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 157 - protein, 1399 aa, Olsenella uli
MNLRNTTDEYNIGLDMGTNSVGWAVTDKAGAIAHFKGKPTLGSRLFDAAQTAAGARIHRSQRRRYVRRRWRLDLLQSLFQDEVSKVDSEFFCRLRQSRLYVGDREKGHADYTWPIFNDSDFNEVDYYKRFPTIYHLRKWLMETDEKADIRLIYLATHNIVKHRGNFLRENNKSLSSRDANPAQAVKSLRLALNDWCSERDYECAWKGEEDDGAIDEAILNVLADGEKGRSDQAKEIAKLTGVDCGDAKQSKQCNEAIAKAIVGLKVEMKNIFGEFPAEKTSYIYLSSDEDVEAVRESCPDDSGELFQALCKLYSAYILQELLSYADPSGQTISANMVAKYKQYGRDLRLLKELTRTYAPQKYDLFFRGETYAGSSDYVVDEARGYTRYNLGTTKANYDDFQKSVKELFKGTDALQDERYQEMMVAFGEQKFLRRLKTSDNGSIYYQLHLEELHTILENQGKHYPFLLSEEDKIESLVSFRIPYYVGPLTRKNAAIGHDGKERFAWSSRKDGMEHAVITPWNWEEIIDRDKSAEDFIMRMTGDCTYLQGEPVLPKCSLLYEEFCALNEFNGAHWTVDGDDERRFDAAQRERIMCDLFRRTRSVTYNKVSDWLERKYNFTGARVRGGQGEHGFESKLGSYIFFCKDVFKTDGLDEADYTMIEQIILWSTLFEDRDILKRKIEEAYGGDRLTSEQIKVICKKRFTGWGRLSKRLLTDIKVNTDTGRKSIMDVLREGNPNNGQRSRTMVFMEVLRDEDLGFQKAIDGLNRDYFREHNNGLMDVNDLPGSPAIRRSINQAVRIVDEIASIARKEPTNIFIEVTREEDDPRKKGKRTKRRYDAIKSALEKFKKDDPSLWKELCEKAPGDMDERLSLYFMQRGKCMYSGRPIKIEELHTGKYEVDHIIPRSYIKDDSFENKVLVYREENQHKTDALLIDSSIRQKMGGYWRMLHDAKLVGDKKFRNLFRNHIDDKAMKGFVARQIVETSQMVKLVQTLFEARYPNTRIVPVKAGISHDLREAAGLVKCREANDFHHAHDAFLACRIGLFIQKRHPSVYDNPIGLARIMRDYARMQAREYKKSHCLAHTQGFIVNSFLSSGFDEETGEIFKDDWDAKAEVEGIRRVLNCRQCFISRMPVEGDTRYGGRYWGETIYSPKGKHKHEIPLKQGLDPNLYGGYSDLLYSYFLIYEASDVSSGERVLRFIGIPTSIAARMANQKRLEEYVSRLALQENLEHVRMVRKIMKKQLIEVDNCRLLVTAADAVTNATELAFSLDEMKIISTCAKCINGADPSAIDKIGNAQDSFFDNLKRRGSDRCALLFSQLKLDKLSQNFYMISSDDKSKILISILDRIRAKSNSVDLSLVGGAKHAAQMKFDFNAKLNNPASSFVLIDQSVTGMFERRTRIGL

SEQ ID NO: 158 - protein, 1398 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLSNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 159 - protein, 795 aa, Prevotella disiens
MEKQRILGLDPGTNSLGWAVLDFDNSKQEYNLVRKGEVIFEEGVGKSKRGEFSKAAYRTFYKSTRKHYFRRRLRKIEVLKVLVKYDFCPYLSDDLLKQWHEKKIYPAVKEFMDWQRTSDAEGKNPYYDRHCCLNEKLDLSLKSDRYVLGRALYHLTQRRGFKSNRLIQNNDENEEGKVKKGISELSTEMQEANCNYLGDYFYKLYTEKGNTVQIRKRYTDREKHYKNEFNAICEKQELNETIVKELDKAIFFQRKLKPQRHGVGKCTFEPNNRRCAISHPDFERFRMLCFINNIKIKTPFEENLRPLNNEEKALIEPLFYRKSIKNFDFEEIAKKLAGKNNYCYIKDDSSKQYKFNYRMSQGASTCQTIAKLKSIFGEEWKNGIAETYTNRRKKEGLKKQAEMVDDIWNVLYSVSECDVLKDFAINKLQLDEKTADNFSKTKLAQGFATLSLKAIRKILPFLEQGFGYTEAVFLANIPTVVGKEYWNNEDIRNDIMEEIKTIFYHNTLKTNDSHNTILFCIKDILSNNFDLAPGAIDKLYHPSMINVYKDVIPNEDGILQLGSPKIDAVKNPMAMRSLHIIRKVVNELLREGIINSDTEVRIEYARELNDANKRHAIADWQKKQYGKHQKYRKEIKELFKAETGFEIEPNETDILKFELWEEQNHICLYTGQEIGISEFVGENPKYDIEHTIPRSLGGDSTKMNMTLCENKFNRENKQKKLPSELANHSEILERIDDWKKKIYILQKKYDSIRTHNGMDKENKDKKIVSMQVRISGSSICVYSQNTLLWLQYGYN

SEQ ID NO: 160 - protein, 1428 aa, Unknown
  Burkholderiales bacterium
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRKGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVHSICNAIENERKTYGPYFSEDYKFVKTALKEGKTEKELSKKFAAVIKVLKMVSEVVPFIGKELRLSDEAQSKFDNPYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGASDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 161 - protein, 1025 aa, Unknown
  gamma proteobacterium
MGGYMPQLMRYRLALDIGSTSIGWAMIRLSMQNEPIAIIRMGVRIFSDGRNPKDGSSLAVTRRVARQMRRRRDRLLKRKTRLLNALVQKKFFPEDADARKALVVLNPYELRKEGLYRQLSGPEFGRALFHISQRRGFLSNRKTDKKDNDSSVLKKAIVDLRQQLEVENCQTIGEWLFKQQQSGKSVRARLRGKTQKDKAYDFYIDRAMIAHEFDTLWVSQAKYDPLLFNEDARAILRDILLYQRPLKPVKPGRCTLIPDESRAPLALPLTQQARIYQELNHLRITTPALGAQALTVAQRNTIAALLEKSDVTFVKIAKALGLTSTTEFNLQDIKRDRLKGNATAIILARNQYFGRRWHDFNADLQNLIVDKLVNEGSETALIEWLKANTDVDESAAERVSGVTLPEGYGSLSVAALRRLLPALKEDVVVYSEAVKRAGFDSHSALSLIEQTGELYQELPYYGEVLQRHVGFGSGDPNDSPERRFGKIANPTVHIGLNELRKIINALIKRYGNPAEVVVELARDLKLSREKRKEIQEEQKQRQDRNEKRIKDACEILGIDPLVIDRGKRREISQKMQLWDELNPKDAANRRCPYTGDQISIEKLLSAEVEIEHILPFSKTLDDSLNNKTVAMRRANRDKGNRTPYEAFGESLNPDYDYDAILQRASLMPREKRKRFASDGYQQWLRDDKDFLSRALNDTAYLSRIAKEYLTLICPPNSVRAIPGRMTAQLRAMFGLNRLLSEGGIKNREDHRHHAIDAAVIGVTDQGLLQKFSRASARTRELQLSRLVDDMPLPWDTYREHVTRALEHLVVSHKPDHGYQGKMHEDTAWGLRDNGQVTRRVRSEDGGPRQRLLENKNVVKINSTRDFSRHGIDEQGQVNAYKGYVGGSNYCIEIWIDEKGKWNSDVVSTFQAYQIVRELGEKAAWQKLRNPLLSLSAKPLVMRLIIDDVVKMQIAGQNKIMRVVKIAQNGQIFFAEHNEANVDARDKDKNNPFKYISKTAGSLQKAGGIHMAISPIGDARPVRYGR

SEQ ID NO: 162 - protein, 1364 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDFREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNGENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTGNFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLQPYFVYDNFKKFGNKEDIGHKRFNFLGKIEREKKVVAPETGEILWSNVAPNETIKQIKKVYDYKFMIVSREITTRRAELFNQTVYPKNYHGKLIPIKEDRPTDLYGGYSGNTDAYLAIVALEDKKKGKYFKVVGIPTRVAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 163 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 164 - protein, 1089 aa, Corynebacterium matruchotii
MNSANVNYRVGIDVGSYSLGMAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQAGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 165 - protein, 1134 aa, Streptococcus mitis
MNGLVLGLDIGIASEGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKLRLINVFSTSAYKKEAERILRKQQEFNNQITDEFIEDYLKILTGKRKYYHGPGNEKSRTDYGRFRTDGTTLDNIFGILIGKCTFYPEEYRASKASYTAQEFNLLNDLNNLTVPTETKKLSEEQKKVIVEYAKEAKTLGASTLLKYIAKMIDASVDQIRGYRVDVNNKPEMHTFEVYRKMQSLETISVGELSRNVLDELAHILTLNTEREGMEEAINTKLKDSFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPDNIFHGHKELATKIRLWHQQGEKCLYTGKTIPISDLIYNQYKYEIDHILPLSLSFDDSLSNKVLALATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKTGKLVDFNPFEKYRQENEPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGDKPKLKF

SEQ ID NO: 166 - protein, 1373 aa, Streptococcus bovis
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 167 - protein, 1099 aa, Corynebacterium accolens
MSLLYRVGIDVGTYSLGCTAIEVDDNDQPVSILSSVSLIHDSGLDPDQQKRAVTRLASSGVARRTRRLYRRRRRRMVKLENFLTAQGWETLPFERYSDPYLPWHARVALVNGYISDDTQRGQYLSIAFRHIANHRGWRNPYWKVSSLYSPDKPSDAFEQIRKELEASTGRQIPETATVGQLISFAQFGKDRLRGGGKQKDKKKPQEQVNQAVISARLHQIDHAREINEICRVQKIDDTLRKQILDLVFAAESPKGAQKGRVGKDPLQPKLFRALKASDAFQQYRIAALTGNLRIYRNGVTVPLDRDEKLIVFNYLVNLPKKEEPSWLKIAEILNIDRGQLRGTATMTDDGERAGATPPVHDTNRTILDSKVKPLAHWWENASDDERAAMLKSLSNSEVEDFDSPAGAQVQAFFADLDETEQEKLDSLHLPMGRAAYSEDTLMRLTNRMLDENLDLYEARLAEFGIPKDWAPPAPRIGEPVGNPAVDRVLKGVARWLEAAADEWGAPKSVVIEHVRDGFVSKSKAIEIDRANNNRHKRNRELFQKMQENLGIEGKVRSSDLWRYQSVQRQNCQCAYCGSPITYTTCEMDHIVPRAGEGSTNTRDNLVATCHRCNLAKKNIPFAVWAEKSTIPGVSVKEALDRTRHWSEDSGMSKKDFQKFRKNVCERLNRTVVDEPLDARSMESVAWMANELRGRVAQRFQEENTTVNVYRGALTAEARRAAGITDKLRFIDGTGKSRLDRRHHAVDAAVVAFIHNYVAETLAIRSNKKREAQLLQGTSQWKEFTGSDDKHRAVWNAWIPKMQKLAVLLQIALDEDRIVVTSNLRLRLGNGRAHEDTISELKTIRVGDAISVTDIDRASSEALWCALTREPDFDEKDGLPENPNRRIRVHGTWYDAEDEIEVFPVGAGAIKVRGGYAKLSRFHHARVYKIPGKKAPIYCMLRVYNTDLVQHRHEDLFSVELKPQTMSVRQAEPKLRKALAENTAEYLGWLVTDDELIIDTSTFRTGLIEEMQSEFGLVRRWRLDGFDSPSLLTLRPLHMSAEGLPDDCALGSRKIIDTKGWRVSINKVFNAGNTTVVRRDALGRARLTSNAHLPISWKEE

SEQ ID NO: 168 - protein, 1054 aa, Actinobacillus pleuropneumoniae
MKLTPLNYILGLDLGIASVGWAVVEIDEQENPLGLIDVGVRTFDRAEVAKTGESLALARRLARSSRRLVKRRADRIKKVKRLLKSENILLSADEQLPNDVWQLRVKGLDQKLERQEWAAVLLHLLKHRGYLSQRKNESKSENKELGALRSGVAANHQILQSAEYRTPAEIAVKKFHVEEGHIRNQRGAYTHTFSRLDLLAEIELLFTRQTELGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKHRESAVQKFKEYFPNFVGEPKGKDILKMRLYELQQAKCLYSGKSLELHRLLEKGYVEVDHALPFSRTWDDSFNNKVLVLANENQNKGNLTPYEWLDGKNNSEPWQNFVARVQTSGFSHTKKQRILSHKLDEKGFIERNLNDTRYVVRFLCNFIADNMLLTGKGKRKVFASNGQITALLRGRWGLQKVRDDNDRHHALDAVVVACSTVAMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLNDLERMVNREREMALYESLKVRLEQFDNDPAKAFAEPFYKKGGALVKAVRVEQTQKSGVLVRDGNGVADNASMVRVDVFTKAGKYFLVPIYTWQVAKGILPNKAVTANVDEIDWLEMDESYQFIFTMYPNDLVKVKLKKEEFFGYYGGLDRATGAIVIKEHDLEKSKGRQGIYRIGVKLALSFEKYQVDELGKNIRPCRPTKRQHVR

SEQ ID NO: 169 - protein, 1369 aa, Lactobacillus iners
MNNNYYLGLDLGTNSVGWAVTDDHYNIIKFHGKHMWGMRLFEEAETAKDRRLHRQARRRRQRLVERINLLEELFDKEISKVDQGFFARKKESDLHFEDKTTKSEYALFNDKSYTDRDYYKQYPTIFHLIMDLIENDKKRDIRLVYLACHYLIKHRGHFIFDGKNFTVDNSFENLLDKLITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKILDNQSKYYDFLLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKVDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 170 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 171 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 172 - protein, 994 aa, Streptococcus downei
MENQRGKRQRITHQEPYSIGLDIGTASVGSAVINNDLTVPQKRFKVRDINGNVIKTIKKNMSSVLIFDEANPAKGARTKRTSRRRYTRRNFRLLELKKLFEKEIEKIDPNFFHRIKEDSFFNWNDKEFDKHPLFGNLKEEKKFHNNYPTVFHLRNEIGKNSSKKFDLRLVYLALAHIIKYRGHFLDETFDPDASVSVEKRLNDFIVEYNELFDKDLRSEAKFSEILMSDSSNSVKIESTLSLYPSEKNTIFQVFLKLIVGNQGDFNKFFKDELESSSHSGKLVFSSDEVEDEKEELISIIGEDYLDIINLCQSLYSTVALAKIISTDTGESNTPLSASMVKRYNEHKGDLANLKGIVKHFIPEKYEEVFGEHSKTGYTAYIRNPNKMPEKKFYDYLYHEGEKGKISGILSDSRIYELPAVQKFILKIEQKSFLKKQRTKENGLIPYQLHLKELKIIIENQSEYYPFLHEIEEKLEKLLTFRIPYFVGPLAQTKYINPRFNWLVRKSEDHIKPWNFSEIVDEEKSATKFIEKLISNDQFLFGEKVLPKRSIIYQQFLIFNELTKVSYQIKDGPSRNFDSETKEEIFNSLFKKNKLGCVTVVDLKNYIKNDQCLSEKEDIQIEGIKKKFNSSYSTYADLSEISGLKELLDDDTQLDLVEEIIRILTVFEDKKMRTKQLEKLNLPANVDIEKLCKKHYKGWANVSRQLIDGIADRSRGFKKTILDYLKDDDIPNNDAFSTKVQKSLNRNFAQLITDKSLDFARKLDESYKIDVKKDYPSLVEDIPGSPAIRRAILQSLYTVDEIIGVMGRMPKNIVIEMARTNEVSDSPKTRKERIKKLIKETENDADALNFGISKVSEIFDEVKKDENLFKELEVYLYFLQEGKDMYGTETREGHRQPKEINFYDVKNSTGKYHIDHIIPQSLYSGNPLDNIVLTESTNNKIKDKDVPDEATVYEMKNFWLYLMKKGAISKKKFSFLTKIEQGGLSNEDKFGFINR

SEQ ID NO: 173 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 174 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 175 - protein, 874 aa, Listeria seeligeri
LANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMNDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 176 - protein, 1082 aa, Neisseria lactamica
MAAFKPNPMNYILGLDIGIASVGWAMVEIDKEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFSNPHVSDSLKEGIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEAPTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDNPAKAFAEPFYKYDKAGNRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKNQIDELGKEIRPCRLKKRPPVR

SEQ ID NO: 177 - protein, 1326 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 178 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 179 - protein, 1150 aa, Enterococcus faecalis
MYSIGLDLGVSSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGINDVAKLLGVKKERLSGWRLDKKGKPEIHTLKGYRNWRKIFAESGIDLATLPTETIDCLAKVLTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKNNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQCYDVRFYNFQSANSINFKGLEQEMMPAENQFKQKPYNNGAINLNIAKYGKEGKKLRKFNTDILGKKHYLYYEKEPKNIIK

SEQ ID NO: 180 - protein, 1345 aa, Streptococcus anginosus
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 181 - protein, 849 aa, Listeria ivanovii
  misc_feature (780)..(780): Xaa can be any naturally occurring amino acid
LIDKNGTPQHITMIDKMRGKCTYFPEEVRIAKMSYTAELFGLLNDFNNIYFADPETGEKIGFTEADKKYFIDTFIHDQKGVKNITLKQIMKHKNIINETDIFGYRINTKNGTPIFTEFKGLKALKKALKEVDLPDEFYQNTEMMDEIANILSSEKSFTRREEQLKELFLAAFNDELEEAVKELINDITFKEFHSLSKKAIMVILPELWSTNQNQMQLFVQHKMDKSRLENLQNGTKIQFDDEAILSTIAKRAHRETIKIVDAVRAKYGELDYVIVEMAREKNSDEQKKVYNRAQKKQGDFEKEMCKLLGVSELKELRLNGKQHLALKFWKEQDGKCIYSGKPIALSDIVNNFNGLLEIDHIIPISISYDDSQQNKVLCLRSENQRKGQLSPYQYLIRGMGERSFDAFKAEVLSRHFGKKKQNYLLEMEDIANNDELRKHFINRNLVDTRYAMRTFSNTLKTFYTVNGIPTKVMPVNGAMTSALRKRAKLNKDRDAGHAHHAIDALIVAAIGRLPLIKQLAELRVNEEGEFADKITDKGLDDKTAFDDKTLKFLRNLLNYESKVKYSHKVDRKPNRSLSKQTLYSTREKDGEKYIIGKVKNIYTLDKAGYAALKKRIDKNPEDFLMAQHNPKTWEEIIKIMEVYSKADNPFKEFYDEHGFIMKDGKVPVKSLRYHDKKLGIHVPLTHKYENTRHDVVLLKRNSLRVDIYMNKEGVYKYQGVPYNWFNQKGDKYILDMEKYHNEIDGTRASFKNIDNTFEFQFSLYKNDVFSYMKKDKEGEXVSYTKLFRSDSSPRENRLEVENIDMRTSSQQMPTINPLKNLIKYNTDILGNTYPIQKEKFVTVFTLHSK

SEQ ID NO: 182 - protein, 1457 aa, Prevotella buccae
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGATLKTDKEGYVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQHWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIAEMNQNISKYNDGKPHQPILKVRITEPMGAKYRVGQTGNKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGNECHFIPYYVANVIYNKGGFNMQMHRPQS

SEQ ID NO: 183 - protein, 1330 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 184 - protein, 1123 aa, Mobiluncus curtisii
MFVYLNSPRGFGPATFLTDLPHFCIIFGNNDFMDNRKYHVGIDVGTNSVGFAAVEVGDSGSPIRFLNTMVVIHDSGVDPEQKKYAITRLASAGTARRTRRLYRTRRQRLRELDDFISNELGYPLVNLENFADPYEPWKVRADLATIKLPADELPEAMSIALRHMARHRGWRSPYQRVEALHLHAEISEEFSALKKRVMEKTGDVFSDDATPAEVLVDLMGRQKIRGADGMLSGKLRQSDNANELRKIASVQGIDDETLNRIIDRVFFSRSPKGKASERVGMDALPGQGSKPRALKAMPSFQKFRIVSVICNLRIKDSGDDNRPLSMEEKEQLIGYLMSSTTDDHVTWTDVAELLHVKRSNLQGTAKEGPDGERPYTRPPVNSAWSKIKDSKIKSLVALWKTGDVDVQSAIVEALSNASVLEDARPGADIVVAYLESLDDKELESLDKVGLPAGRASYSEDSLERLTERMLQDDCDLFEARKREFGVSDDWKPPADPIYAPVGNPGVDRVLKIVNRLLMAAEREWGAPTQINIEHVRSGFSSELMQREFERENERRRAQNEEAVKAILTEKGGNSHVSKYDIIRYYAVKRQNCQCLYCGTPITFSDCELDHIVPRKGVGSTNSRVNLAAACRSCNRDKSNLPFAVWAGKTSNFDVSIDGAVSRVKQWQRSQNEGAREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETAREHFAVWKSNMERLTDLFNDKLENDAIPVVQPLRLRLSDSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKIFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILSGQGWRPAINVLFSKGKPRIVRRNSLGIERPSSNNGLPFSWEA

SEQ ID NO: 185 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 186 - protein, 586 aa, Pseudoramibacter alactolyticus
MTYYLGLDMGTGSVGWAATDKNYKLIRAKGKDLWGVRLFQTAKTAAERRSHRVARLRRQREKVRIGYLKTIFSDAINKVDPGFFQRLDDSFFYAEDKNINQPYALFADTGYTDVDYYRDYPTIFHLRSTLIHDTSPKDVRLVYLAVLNMFKHRGHFLASNLSENGVDDFGDIYQQWCKSVPKPVQISDPEAKTEKIENILSKAGISNTRRLEALLEVFGIKRRDAFAEVLKLWCGLKGNLSKIWSETDFSDLDNTKPALSFKDSNLDMVLSQLEEILPDEDYSWLMLTKQIYDWSLLSGMMKDASGKSYDYLSDARVASYQKHSEDLKTLKRFYHDNHLSAAYDQMFRVMGKDNYSAYAGSVQSKKEVVRRGASCGIEELYKRIKKDLKPVPDCETKQIILENIERGTFLPKQLTRDNGVIPNQIHVHELKAILKNAENYLPFLKEGSELTNSEKILQLFQFQIPYYVGPLYSDENNYAWVVRKEGGRVFPWNFAEKVDEKASAEGFISELVARCTYLDNEKVLPKASLLYEKFMVLNELNNLRINGERISVDIKQELYQNLFTRGKKVTLKKSEGLFGGQRIFCL

SEQ ID NO: 187 - protein, 1385 aa, Gemella morbillorum
MKNKTWYLGLGVGPTSIGWAATDSNYKLLRKNKKRLWGVRLFEEAKTAVDRRTFRAERRRLARRKWRISLLEELFAKEVSKNDPNFFLRLKESKYHFEDKSLMNEYILFNDKDYTDKDYYKEYPTIYHLRLSLTTEENPDIRKVYLAVHSMLKNRGHFLLQGQSFNDSNIDSVIKELLELETVKINFEVTDEVIHSLKKIALEKKNLSDKNNDVKKLYPKEKQLQEIFKLVFGGKTSLDKLYDIEEYKELDNSVKSISFKEKVYEEVRPDYEQILSNYIELLDLAKLVYDSIVLADIKKEGKTISESKVELYNKHKDDLANLKKLVKIDSKLSEDKKKEVYFTIFKEDKEKGTNYVNYTHRSQEGKSCSYEDFKKFLKKELEKLEDSPTKTTILEELDLETFLPLQRTKDNSVVPYQIHKEELVKILDNAAKYHSFLAEKDDSGYSTREKVVQLFEFRIPYYIGPLNAHHNTENGGYSWAIRKKGMESVPVTPWNFKDVIDESASAEAFVNNLKNKCAYLSGEDVLPKNSLLYSEYALLNELNALRYEGNRISVEARDVIVTKLFKEQGKKVTKKTIKELLKTEGFIDGKGEIVGIDNIVKNDLKSYRDFKKILADKFDKERVENIILWITLYGESRKLIKEKITKVYGDFYTVDEIEKMSRLTYKDWGILSRKLLTELVSEKLYNEETGECLNIIGAMRQGTILFMELLADKFDYMSQIKNHNKENKDDITEITPDILENLHASPAVKRSIWQTVRIVEELKTIIGCVPTKIFIETTKRNNAPYKVPTLNRNDLVTKYKTIREHEIFELEKELKNTLDFTLNKNRLINEEPSKLKATKLYLYYTQLGRCMYTGKKIDLGELFDNNNKYDIDHIYPQSKVKDGSFNNIVLVTKASNDMKADVFPLKSKFQTKENKIFWRFLKEKKLITEEKYNRLVRTEEFSNGELTGFITRQLVETSQAIKVISNVLRELNPETTICYSKAENVSSFRQSFGKIKEANRKAENNEKLIRVQEINDYYNAKDAYLSIVVGNVYDVKFTRNVHNFIKNNKDARRYSLNGLFYTDVKNANTIAWEMDKTVHVVEKTMNNNNILITRRTSEQKGALYDATLYKAKVAEKAKEGTYYPLKTTDSKIKDVGKYGGFTKIKIAYYSIFEYTLDGKKGKQKITRIVPIPIYISQNIKDDKALLEYAQTRLPGKDLKIKYRKLCIGSLVKINNFNYYIGGKTNNNFTFDSAVQVILDKDSESYIKELAKYLNWKKENKDGKLWESITEDKNIQLYDSLVKKMNTGIFIRKTPNKYTELLTLEVKNKFINIDIDEQVKLLLEILNLLTNKKFTSKLNEIGITASRGVCSFNLSNQSQFSIIEQSVTGVYEKEKLIIEKKKEGIL

SEQ ID NO: 188 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 189 - protein, 1422 aa, Sutterella wadsworthensis
MTQSERRFSCSIGIDMGAKYTGVFYALFDREELPTNLNSKAMTLVMPETGPRYVQAQRTAVRHRLRGQKRYTLARKLAFLVVDDMIKKQEKRLTDEEWKRGREALSGLLKRRGYSRPNADGEDLTPLENVRADVFAAHPAFSTYFSEVRSLAEQWEEFTANISNVEKFLGDPNIPADKEFIEFAVAEGLIDKTEKKAYQSALSTLRANANVLTGLRQMGHKPRSEYFKAIEADLKKDSRLAKINEAFGGAERLARLLGNLSNLQLRAERWYFNAPDIMKDRGWEPDRFKKTLVRAFKFFHPAKDQNKQHLELIKQIENSEDIIETLCTLDPNRTIPPYEDQNNRRPPLDQTLLLSPEKLTRQYGEIWKTWSARLTSAEPTLAPAAEILERSTDRKSRVAVNGHEPLPTLAYQLSYALQRAFDRSKALDPYALRALAAGSKSNKLTSARTALENCIGGQNVKTFLDCARRYYREADDAKVGLWFDNADGLLERSDLHPPMKKKILPLLVANILQTDETTGQKFLDEIWRKQIKGRETVASRCARIETVRKSFGGGFNIAYNTAQYREVNKLPRNAQDKELLTIRDRVAETADFIAANLGLSDEQKRKFANPFSLAQFYTLIETEVSGFSATTLAVHLENAWRMTIKDAVINGETVRAAQCSRLPAETARPFDGLVRRLVDRQAWEIAKRVSTDIQSKVDFSNGIVDVSIFVEENKFEFSASVADLKKNKRVKDKMLSEAEKLETRWLIKNERIKKASRGTCPYTGDRLAEGGEIDHILPRSLIKDARGIVFNAEPNLIYASSRGNQLKKNQRYSLSDLKANYRNEIFKTSNIAAITAEIEDVVTKLQQTHRLKFFDLLNEHEQDCVRHALFLDDGSEARDAVLELLATQRRTRVNGTQIWMIKNLANKIREELQNWCKTTNNRLHFQAAATNVSDAKNLRLKLAQNQPDFEKPDIQPIASHSIDALCSFAVGSADAERDQNGFDYLDGKTVLGLYPQSCEVIHLQAKPQEEKSHFDSVAIFKEGIYAEQFLPIFTLNEKIWIGYETLNAKGERCGAIEVSGKQPKELLEMLAPFFNKPVGDLSAHATYRILKKPAYEFLAKAALQPLSAEEKRLAALLDALRYCTSRKSLMSLFMAANGKSLKKREDVLKPKLFQLKVELKGEKSFKLNGSLTLPVKQDWLRICDSPELADAFGKPCSADELTSKLARIWKRPVMRDLAHAPVRREFSLPAIDNPSGGFRIRRTNLFGNELYQVHAINAKKYRGFASAGSNVDWSKGILFNELQHENLTECGGRFITSADVTPMSEWRKVVAEDNLSIWIAPGTEGRRYVRVETTFIQASHWFEQSVENWAITSPLSLPASFKVDKPAEFQKAVGTELSELLGQPRSEIFIENVGNAKHIRFWYIVVSSNKKMNESYNNVSKS

SEQ ID NO: 190 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 191 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 192 - protein, 738 aa, Treponema phagedenis
MLQELFAKEIAKIDEGFFRRLDESAFYLEDKSLKQKYSLFNDDNFTDKDYYKKFPTIHHLIKALINDETHVDIRLLYLACHTIIKNRGHFLFEGKEFNTESRFDDAINELFSYLRQDMEIDFAFEDKIADIKEILENKKIGMRDKQNALNKKLSIAPKDKQKKEIIKLIVGASFNLKTLFNDEKYSSEKESYSFAKSNYEEKEAVLESLLGDGFGLILRAKAVYDSSVLSEILGNETYLSFAKVKIYDKHKEDLAKLKKVIKTYHADEFKKVFAEANIQGNYCSYVGSCKKNGKKVPIEKRADKDAFYDFLKKILKDEKAKNSDADYAFILNEIELKTFLPKQVSKKNANIPYQLRRMELEKIVNNAEKYFSFLSEKDEYGTVKEKIIQLLTFKRPYYIGIIQDTHKEKFPDRCWVVKKENAKNEKITPWNFYDHIDEDKTAEAFITSRTNKCTYLIGEDVLPRNSLLYMEYTVLNELNNLKVSVDGVNIFDVKLKKKIYEQVFKQRKEVSKKTIADFLKKEGICKKENDVVITGIDEKCTTSLKLYIDIKKIIGKRIEEEPTKNALEDIILWASIYDEGEGRKILEAKIQSVYPDVFTQDELNKILKLKISGWGRFSRKFLESIVASFPGFTDTINIITAMRETNFNLMELLGDAYGFSKGIEKFNSKFNDDKKVFSYDKLVKDLYLSPSVKRMLWRALVIVKEVKSIMGKDPKKYLLKWQEEKKLKREGLPPAMQV

SEQ ID NO: 193 - protein, 1377 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 194 - protein, 1128 aa, Streptococcus vestibularis
MSDLVLGLDIGIGSVGVGILNKVTGEIIHKNSRIFPAAQAENNVERRTNRQGRRLTRRKKHRRVRLNHLFEESGLITDFTKVSINLNPYQLRVKGLIDELSNEELFIALKNMVKHRGISYLDDASDDGNSSVGDYAQIVKENSKQLETKTPGQIQLERYQKYGQLRGDFTVEEDGKKHRLINVFPTSAYRSEALRILQTQKEFNPQITDEFINRYLEILTGKRKYYHGPGNEKSRTDYGRYTTKKDSENEYITLDNIFGILIGKCTFYPEEYRAAKASYTAQEFNLLNDLNNLTVPTETKKLSEEQKNQIINYVKNEKAMGPAKLFKYIAKLLSCDVADIKGYRIDKSDKAEIHTFEAYRKMKTLETIDFEKMSRDQLDKLAYVLTLNTEREGIQEALDHEFADGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGRAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKSLSNKKKEYLLTEEDISRFDVRKKFIERNLVDTRYASRVVLNALQEHFRAHKTDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRQAKVGKDKKDETYVLGKIKDIYSQTGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKDSNNKVVLQSVSPWRADVYFNKTTGKYEILGLKYADLQFEKGTGTYKISQEKYNVIKKKEGVDSDSEFKFTLYKNDLLLIKDTETKEQQLFRFLSRTKPNVKHYVELKPYDKQKFEGNESLINVLGAVAKGGQCQKGINKPNISIYKVRTDVLGNQHIIKNEGDKPKLDF

SEQ ID NO: 195 - protein, 1080 aa, Unknown
  Methylocystis sp. ATCC 49242
MRVLGLDGGIASIGWALIEIFEDHEPSDGRIIDTGAWMFDAPEEKSQTGTKLKSELRRIFRGQRRVIRRRRQRMNEVRRILHRHGLLSSDNRDALKQPGLDPWKIRAEGIDRLLSPIEFAVALGHIARHRGFKSNSKGAKTSDLDAESSRMKKAVGETREKLARFGSPAKLLVEDEGFVLRQTKLKSGALETVRRFRNRDGDYSRSLLRDDLAAEVRALFRAQARLQSTFAKVELEAEFTQAAFFQRPLQDSERLVGPCPFEPAEKRSPKRGYSFELFRFLSRLNHLTLREGSEERTLTVEELRTAAADFGGVAKFTFSTLRKRLALPDIAIFVGIKADDEKKLDVVARSGEAATGTARLRRVVIDALGELAWGALISAPERLDKITEIITFRSDLDRIRAGLIEAGFDTPLIEAIVRAAADGKLDAFTGVGHISAKAARNIIPGLMRGMTYDKACAAAGYDHTASRERDAFDVGMHGKEALKKILQEERISRELVGSPSARKALIEAVKQVKAIIEKYGVPDRIHVELARDVGKSIEERRDIHFGIEKRSRQKDKLRELFGKEVGHLPQDGERGKEELLRFELWNEQMGRCLYTDEYINPKQLVASDNSVQVDHILPWSRFGDDSYLNKTLCTAKANQDKKGRTPYEWFRADKPEAEWDAFVARVESIQFMKGLKKRNYKLKNAEEAAEKFRSRNLNDTRWTCRLLAEALKQLYPKGEKDKDGKERRRVFTRPGALTNRLRRAWSLQRRKKSEKGERIADDRHHALDAIIVAATTESLLIRATREVQDIERKGLHYDLTKNITQPWPGFADEALDAVEKVFVARAERRRARGKAHDATIRHIAVRDDEAKVYERKKVGDIKLGDLIRVKDAERNAPLIENLRKWIEAGSPRDNPPLSPKGDPVSKVRLVTKNKVNITLDTGNPERLATVDRGEMARVDVFRKANRKGKYEYYLVPIYPHEIATMETPPMRAVQGGGDDDKWPEIDSTFEFLWSINQLSLLELTKPDGEVIRSYFRSLDRNTGALTVSGIANSTATRKGIGTRTLIDFKKLHVDRLGQIFEVERELRTWRGETWRGKDCI

SEQ ID NO: 196 - protein, 1087 aa, Phascolarctobacterium succinatutens
MLRMKYAIGLDIGIASVGYAVLALDHEENPWGIIRLGSRIFDVAENPKDGASLALPRREARSVRRRLRRHHHRLERIKNLLINTEFITKDELLHLYDGNLSDVYELRVKALDYSVTNAELTRILLHLAQRRGFKSNRKSDANDKEAGQLLEAVSANAKRMQENHYRTVGEMFYKDDLFSKYKRNKGGTYLTTVHRDMIAAEARTILEKQFALGNNICTQDFIDKYLSILLSQRQFDEGPGEPSPYAGNQIANMIGKCTFEPNEYRAAKASYSFERFNLLQKVNHLRLLLEGKSIALDNEQRKKIIALAHDKADLRYSHIRKALGLDEKVLFNTITYNDDVSVIEKKTKFNFLQAYHQIKKVLAEDMQKLTTEQLDNIGQILSTYKSDNKRTEELSALGLEKKIIDALLGINGLSKFAHLSLKALRKINPYLEEGKIYNEACTAAGYDFKAHANTQKTELLPAYKEEMDDITSPVARRAIAQSIKVINAIIREQKGSPLYINIELAREMAKGFDERTQIDKANKENQAKNERIMERIRTEFHKANPTGMDLIKLKLWEEQDGRSPYSQKAISINRLFEPGYVDIDHIVPYSISFDDSFKNKVLVFSDENRDKGNRLPIAYLQSKFGAKAAENFMIWVQSNIKDYKKRQKLLKREITEEDINKFKERNLQDTKTISRFLYNYINDYLLFAPSDTGKKKRVTAVNGTITAYLRKRWGINKIRANGDKHHAVDAVVIACTTDKMIKDLSSFSRYHELEYTHTDTESFLVNSLTGEILKRFPYPWEDFRPELMARLSDNPADALRKLNLIFYHGIDLSTIKPIFVSRMPRHKVTGAAHKATIKSARCLDNGIVICKTSLQNLKLDKEGEIANYYAPESDTILYNALKERLRSYDNKPAKAFAEPFYKPKADGTPGPLVKKVKVYEKSTLNVAVQQNTAVADNDSMVRVDVFHVKGNGYYLVPIYIADTLKKELPNKAIVAYKPYADWPVMDDSNFIFSLYPNDLIKFEHKNSVKFAKVNKESTLNDFYSTKSEIVYFKGCNINTGAITIINHENTYVVSSLGVKTLPSLEKYQADVLGNYTKVKKEVRKPFR

SEQ ID NO: 197 - protein, 1375 aa, Lactobacillus ruminis
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 198 - protein, 1391 aa, Prevotella oralis
MKKILGLDLGTTSIGWALVNEKENNEELSSIIRLGVRVNPLTVDEKSNFEKGKDITTNADRTKCRSARRNLQRFKLRREALADCLKRHGLMTDETPLCETNNSIIFKTYSNRAKAVCEKIALDDFVRVLFMINKKRGYKSSRKLNTDDEGTLVDGMDVAKLLYNEQITPGEYLLRLFKKGKKTRPDFYLSDLKAELERIWDFQRTFYPEILCNALKEDLKGKSRTQSSAIFYAKYKVSTAKIAGKDKRLQELTWRTDALRKQLTIDEVAYVICSINGEVNGSSQRLSMISDRSKLLYFNHQTIGQYLMQRLEENPNAGLKNIIFYRQDYEDEFNDIWNSQATYHKELTPELKKEVKDIIFYQRGLKSCKWLINYCELEHEEIEVKTPEGKLRKITIGSKTCPKSSPLFQEFKIWQVLNNLQVSPLNSRRKAKRKKDEEPSLFSDEDMNTACRYLNEEEKLTLFKELSIKKELKKKDALKLLFENYKELDLNYKVISGNVTMANLYRAFQDIISLTGNGEFDFQAMPAEEAEKTVEEIFGGLGYKTAFLHFDASLHDKEFERQPAYRLWHLLYSYAGDQSKTGIEALVKRIQELCGFEPEYARILANISFIPDYGNLSSKAMRKILPYMQDGYEYSEACSKAGYRHSASSLTKEEINKKNYKTHLDEIKRNSLRNPIVEKILNQMVNVVNSVIDTYSNIDEIRIEMARELKKSKPEREDMSFAISKATKETERIKGILEQEFKIQHVTRNDIIRYRLYEELKPNGYKTLYSNTYIPREDLFSKKFDIEHIIPKARLFDDSYSNKTLELRDINIEKGNQTAYDFVLSKYGEEGLYKYEQRVEEFKKNNEQAGTKCRKLLMREADIPSDFLNRDLNDSQYIAKKAHELLREIVPTVTATTGSITNRLREDWKLVNVMKELNWEKYDKLGLTEEYKDKDGNTVRHIKDWTKRNDHRHHAMDALTIAFTKPSFIQYLNNLNARSNRGGSIYGIEQKELERENNKLVFIPPIDPKIFRKQAKEHLSNILISIKAKNKVVTKNVNKTKSKSGTNRKVQLTPRGQLHLETVYGKIRTYKTEEIKVGTKLTEELIAKVADKKIREALMQRLSEYGGNIKKAFQNISKHPIWLNGSHTKHVPEKVKIVFFEDVFTIRKAITPDIKIDKVIDSKIRRILQERLNEFGGEASKAFSNLDENPIWFNRDKGIAIKSVKIRGIAKGTAIRVKKDIHGKTIIGNNGYPVANDYVNTGNNHHVAIFRDKDGNLQEHIVSFYEATARAIQNLPIVDRNYNSEKDWKFLFSMKQNEYFVFPNPNTGFNPSEISLKDEKNYALISPNLFRVQKLSHYYYVFRHHLETNVDTNLQLKDITWKRITAVNNLTGAVKVRIDHLGRIVDVGEYK

SEQ ID NO: 199 - protein, 1167 aa, Streptococcus sanguinis
MLFGLKTKFKDCFELEEEPDLNFSKENYDDNLEKLLGELGEDFSDVFDKLKILRDTILLSGMLTYTGATHARFSATMVERYEEHRKDLQRFKSFIKQNLSEQDYLDIFGRKTQNGFDVDKETKGYVGYITNKMVLTNPQKQKTIQQNFYDYISGKITGIEGSEYFLNKISDRTFLRKLRTSDNGAIPNQIHAYELEKIIERQGKDYPFLLENKDKLLSILTFKIPYYVGPLAKGNNSRFAWIKRANSSDILDDNDEDTRNGKIRPWNYHKLINMDETRDAFITNLIGNDTILLNEKVLPKRSLIYEEVMLQNELTRVKYKDKYGKAHFFDSEHRQNIINGLFKINSKRVNAERLIKYLSDNHKDLNAIEIVSGVEKGKSFNSTLKTYNDFKTIFSEEFLDSEIYQKELEEIIKVITVFDDKKSIKNYLTKYFGHLEFLDEEKINQLSKLRYTGWGRYSAKLLLDIRDEDTGFNLLQFLRNDEENRNLTNLISDNTLSFDPKIKAIQSKSTVEDDVFDEIKKLAGSPAIKRGILNSIKIVDELVQIIGYPPQNIVIEMARENMTTEEGQKKTKTRKSKLESALKNIENSVLENGKVLHSDEQLQSEKLYLYYLQNGKDIYSLDETGSPAPIYLDQLDQYEVDHIIPYSFLPIDSIDNKVLTHRKNNQRKLDNIPDKETVAHMKPFWEALYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHVHFNRHEENKATLRKHLYSNIMRFFNNPDSKVSKDIWDCNRDLPIIKHVIYNSQINFVKRTMIKKGAFYNQNPVGKFNKQLAANNRYPLKTKALCLDTSIYGGYGPMNSTLSIIIIAERFNEKKGKIETVKEFHDIFIIDYEKFNNNPFQFLNDTSENGFLKKNNINRVLGFYRIPKYSLMQKIDGTRMLFESKLNLHKATQFKLTKTQNELFFHMKRLLTNSNLMDLKSESAIKESQNFILKHKEEFDNISNQLSAFSQKMLGNTTSLKNLIKGYNERKIKEIDIREETIKYFYDNFIKMFSFVKSGAPKDINDFFDNKYTVARMRPKPDKRLLNATLIHQSITGLYETRIDLSKLGED

SEQ ID NO: 200 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 201 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 202 - protein, 1440 aa, Weeksella virosa
MKTILGLDLGTNSIGWALVEQDFENKQGLILGMGSRIIPMDAGIIGKFAEGSSISQTAERTGYRSIRRLRERHLLRRERLHRVLNILKFLPEHYAAEIDFEKRFGQFLAETEPKLAWKKNAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRRNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWDIIDDKTKTRIGKIITGEYDETIKNRVREKAIDLTEENHFQGLQLWLAQYIVYDRHSEADIAGKWNSVADLEQYLSEFKQHSLRNPIVEQVITETLRVVRDIWKQYGKGAKDYFDEIHIELGREMKNTAEERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMNDTRYISKYISKVLSNLVRGEKDDEGVNSKNIIPGNGKITGILKQDWGLNDVWNDLILPRFERMNQLTNSTDFTAWNEKHQKFLPSVPLELSKGFQKKRIDHRHHALDALIIACATRDHVNLLNNKHAKSRNERYDLQHKLRHTTPWQDKEGKVRTKFTEFKKPWETFTQDTKKELEKIVVNFKQNLRVINKATNYYEKIVDGKKVMFKQEGVNWAIRKPMHKETVSGKIDLPRVKVSKGKILTATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYEDNQGKRSYDTIPLNIVIERQKQGLNSVPETNEKGHRLLFSLSPNDLVYVPIEGEVFDETNPDVNRIYKVVSFSGSQMFCVRQDVATSIVYKLEFSSLNKMERTIDGIMIKEICIKLKVDRLGNISKA

SEQ ID NO: 203 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 204 - protein, 1370 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 205 - protein, 1044 aa, Unknown
  Nitrosomonas sp. AL212
MLHKMRYRLALDLGSTSLGWAMVRLNANQQPCAVIKAGVRIFSNGRNPKDGSSLAVTRREARSMRRRRDRLLKRKARMMRTLIEYGFFPANETQRKALENLNPYALRAKGLDEALTPSEFARALFHINQRRGFKSNRKTDKKDSDSGALKTAIKQLHSVLDPQGNDGKPRTVGELLYKRFTDLSKLPKDRTVRARYRQDKIVKDDGKTKIDKYYDLYIDRAMIEQEFDALWKKQSELNPILFTENARADLKDVLLYQRSLKPVKPGRCTFMSEEERAPLALPSTQRFRMYQEVNNLRILREGLKEESLTLQQRDDLINALEKNNRRTFTQIKKLLGVGGSVQFNFEDPKREELKGNTTSAILGKSEHFGEAWFAFNEAKQDAIVLQLIKEENEAKLVRWLQDETGIDEKRAEVIANAGLPEGYGSLCIEALARILPELRRDVVTYDKAVQAAGFEHHSKLNRNEEIPDITFKIESIDRNSGEIKQFHLHKELPYYGEYLQRHVGFGSGKPEDSIEKRYGKIANPTVHIGLNQVRVVVNALIKRYGHPSEIIVEVARDLKQSKDRRDEENKRQAENQKRNERLRKDIADILGISEERVRRDDIEKMILWEELSFDPADRRCPYSGVQVSTVMLLSDEVEVEHILPFSQTLDDSLNNKTVALRQANRIKGNRTPWEAFGTSNISGFDYSGILTRAELMPKAKRYRFAEDGYQRWLKDDAGFLARALNDTRHLSKIAREYMSLICPNTRVIPGQMTAMLRRNFGLNDVLGLNGEKNRNDHRHHAVDACVIAVTDQGLLQRFAAASASARERQLNRLVENMPLPWESYREHVRRAIDGIWVSHRPDHSHEGAMHNDTAYGLRGNGRVSFHKMVEGKREYIEDNLKVIEITDTKAIDRHGLLPTGKPRPYKGYKGDSNYCIEIVRNEKGRWEGEIISTFDAYQLVRKYGIVQLRYPVLSVSGKPLVMRLIRNDFVRLEHEGITRTLRVCKMREDGQVALADVTEANVDARTRTKEICYVFKTGGSLQKAKARRITISPIGELRDPGFKE

SEQ ID NO: 206 - protein, 1045 aa, Acidovorax avenae
MQKEKPLAYRLALDLGSTSLGWAVLRLSAPGEPSAVIRAGSRIFSDGRNPKDGSSLAVTRRAARAMRRRRDRLLKRKARMLAALERHGFFPQDEAARKALEKLNPYGLRARGLESALKPEEFGRALFHLNQRRGFQSNRKTDRKDSDSGALKQAIGTLRAQMHESGCRTVGEWFWKVRMERKPEGVKGQGVRARYRETPFTTDEGKKRIDKRYDLYVDRAMVAQEFDALWAAQATFAPALFNEAARAELRDILLHQRKLRPVQPGRCTLVPEEPRALLALPSTQRFRIYQEVNHLRVLHDELREEALTLAQRDQIVALLERQAKVTFTAMRKALGFSALFNLEDAKRDGLKGNATTAALGKKDLFGPLWAGFDTALQDEIVTQLMTEESEPRLIAWLQEHTGVDEARAQAIANAGLPEGYGSLGRTALARIVPELQRDVITYDKAVQAAGFAHHSDLGFSFEHDADEVERIGERTIASTGEIKPVFAFKQLPYYGRALQRHVAFAKENPRNDEERYGKIANPTVHIGLNQVRVVVNALMCRYGRPTEVVIELARDLKQSREQKLEAQQRQADNQKRNARIRRSIAEVLGISEERVRTLDIQKWILWEELSHDAADRRCPYSGVQISASMLLGERVEIEHILPFSMTLDDSLNNRTVALREANRIKRNRTPWDARTDFEAHGWSYDGILQRAERMPQRKRHRFAPDGYERWLGEDKDFLARALNDTRYLSRVAAEYLRLVCPGSATRVIPGQMTALLRGKFGLNDVLGLDGEKNRNDHRHHAVDACVIGVTDQRMMQRFAQANAQAREDGLTRLVEDMPLPWPTYRAHVERAVRHIWVSHKPDHGFEGAMMEETSYGILRDGTIKQRRKADGSAGREISRLIRITEPSQPQRHGVDAEGRPLPYKGYVGGSNYCLEITVNDKGKWEGQVISTFDAYRIVREGGLRQLRHSTQGQNGQALAMRLVIGDSVRLEVDEQERVMRIVKINGNNGQVFMAPVHEANVDARNSDKNEAFAYTSKIAGSFQKTKARQVTISPIGELRDPGFKG

SEQ ID NO: 207 - protein, 1218 aa, Prevotella denticola
MKASEEKLSKGLSTYMKENNLLTVGAAFAQLEDEGVRIRNNNNYRAIRSQFQHEIETIFMFQQGLSENELYERLVSEKKNIGTIFYKRPLRSQRGNVGKCTLERTKPRCAIGHPLFEKFRAWTLINNIKIRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGEQWKKLYHPSQIAIYRPVSAGKDRSALRLGNPDIGAIKNPTVLRVLNTLRKRVNQLLDDGLISPDETRVVVETARELNDANRKWALDNYNRIRHDENEKIKKILEEFYPKRDGISTDDIDKARYVIDQREMDYFTEEKPYNKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQFAKDKDGKVLLKEGHPLVDPTIKFVIRRELKYKKSTADSGFASWDDLEKAIVDKELFALMKGQFPEETSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 208 - protein, 1458 aa, Fluviicola taffensis
MTKTILGLDLGTNSIGWALINQDFDNKKGEILGMGSRIIPMTQDIKDEFGKGNSISQTAERTRLRGVRRLIHRTLLRRERLHRVLNIIGFLPEHYANQIDFEKRFGKFKPESEPKISFDGNDVFLFEKSYQEMLVDFKIHQPQLVSNGKKIPHDWTIYYLRKKALSKKIEKEELAWILLNFNQKRGYYQLRGEEEEETPNKLVEFHSLKIVEVNADEPQKGKPEIWYSLVLENGWVYRRASKTPLFDWKDKIREFIVTTEINNDGTVKTDKEGTEKRSFRAPKPEDWTLQKKKTEFELSKSGNEVGAFIYESILQKPNQKIRGKLISTIERKFYKEELKTILKTQLFFHKELKDEKLYNACIEELYKNNEAHRSLLSNKGFEHLFINDILFYQRPLRSKKSQISNCPLEKRTYKKEGIEITEGIKVISKSNPIYQEFRLWQWISNLSLYCIEPTETNVTSTFLNSIEDYENLFEFLNNRKEIEQKHLLKYLLENQGFKGKLLTNELEKFRWNFVADKKYPCNETGSLLHTRLSKVKNISPDFLTKEIEHQLWHIIYSVTDKIEYEQALKTFARKNNLDVDSFFEHFKKIPPFESTYGAYSEKAIKKLLPLIRLGKYWNWEAIDSISKDRISKILSGEYDENIKNRVREKAVHLTSENNFQGLQEWLAKYIVYDRHSEGNDLGKWTSVSDLETYLKEFKQHSLRNPIVEQVITETLRVVKDIWIKHGKGTENFFDEIHVELGREMKNNSEDRKRLTNTITENENTNLRIKALLMEMMNDNDVENVRPYSPSQQEILKIYEDGALNSNIELDDEIVKISKKAEPTKSELQRYKLWLEQKYRSPYTGQVIPLNKLFTSEYEIEHVVPQSRFFDDSFSNKVICESAVNKRKDNQLGLQFIKNHSGEKVELGFGKVVQVFTEEQYLDFVKEHYSKNRSKHNKLLLEEIPEKMIERQLNDTRYISKFVSSILSNIVRSEKDDDGLNSKNILPGNGKITTELKRDWGLNDVWNDLILPRFERMNTITNSDLFTTYNDKYQKHLPTVPFEYSKGFQKKRIDHRHHAMDALVIACATRDHLNLMNNQSAKSELKRYDLQNKLRKKEPYFNQKENKQKEAFKDFIKPWGTFTEDSKNALEKIIISFKQNLRVINKATNSYESYKDEDGNLRIGKDGKPEKGLIKQKGLNWAIRKPLHKDTVSGQINLSRIKLPNGKILTATRKNLDTSFDLKTIENSITDTGIQKILKNYLLSKESPELAFSPEGLEEMNNEIEKYNNGKFHHPINKARIYELGSKFNVGQTGNRRDKFVEAAKGTNLFFAIYQDENKNRSYETIPLNEVIEHQKWRASLPKEEQEKIPLVPVNKLKGTFIFSLSPNDLVYVPSNDELERSASIDFSKLKKEQINRLYKMVSSSGSQCFFVKSEVATSVVNKMEYSSLNKMEKSIDNLMVKEICIKLKIDRLGNISKA

SEQ ID NO: 209 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 210 - protein, 1077 aa, Neisseria bacilliformis
MQQKPQRYILGLDLGIASVGWACVWADENEHPTGLLDCGVRTFERAEVPKTGDSLALARRQARSVRRLIRRRAHRLLRLRRLLKREGVLLSADFNENGLVRGLPIDAWALRVAGLDRKLSNKEWAAVLLHLVKHRGYLSQRKNETQSKDKELGRLLAGVNGNREALQNRSDEYRTAAELAVKKFAAENNGSLRNKGGDYSHTFDRKDLQRELHLLFERQRALDNPFTSSEMEAAVDELLMKQRSALQGEAVLKMLGRCTFEPSEYKAAKNTYSAERFVWLTKLNNLRIQYNGEERALSEAERRLLLDEPYQKAKLTYKQVRTILELPESAVFKGLRYGHGEDGLKAESGTLMEMKAYHAVRKALKDAGLEGEWENRIRNPELLDAIGTAFSLYKTDEDIRANLAAFRLSENVLEALLAGLNFDKFVHLSLKALAKILPLMEQGMRYDEACKEAYGDHYGAKEQEDHRLLPPFVADDIRNPVVFRTLTQARKIVNEIVRRYGSPLRVHIETGREVGKSFSDRKEIEKRQEENRKERERAAAHFKELFPNFAGEPKAQDILKLRLYEQQHGKCLYSGKEIDLRRLPEKGYVEIDHALPFSRTWDDSFNNKVLVLGKENQDKRNRTPYEYLDGKGNSGAWRAFAERVSGCRFPYAKKQRLLTQKLDEKTEQGFLERNLNDTRYVARFLCQFIEEKMHLEGAGKKRVFASNGQITALLRGFWGLKKVREENDRHHALDAVVVACSSVSMQQKITRHFRYREELEHIDRETGEVIHGFPQPWEFFRQEVMTRVFSDDPVSELAEKLDSRPEAVHEFVTPLFVSRAPHRKVTGQGHLETIRSAKRLDEKISVVKLPLTQLKTKDIERIVGYPNREPALYDALAARLAAFKDDPAKAFSEPFYKTGKDGKCGVLVKAVRVENVQKSGLLVRKDESGKMQGVADNATMVRVDVFGKNGKNYLVPVYAWQVEKGELPNRAVVAYADEEDWDEMDDSFEFKFSLYPNDLVEVVTKKDKFFGYYSGFNRATGAINIKEHDLSKSKVKNGVYEGIGVKTAQSFQKYQVDTLGKTIRLCKPEKRMGFKKK

SEQ ID NO: 211 - protein, 1029 aa, Alicycliphilus denitrificans; identical to SEQ ID NO: 188

SEQ ID NO: 212 - protein, 1122 aa, Streptococcus suis; identical to SEQ ID NO: 82

SEQ ID NO: 213 - protein, 1428 aa, Parasutterella excrementihominis
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRRGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVRSICNAIENERKTYGPYFSEDYKFVKTALKEGKTEKELSKKFAAVIKVLKMVSEVVPFIGKELRLSDEAQSKFDNLYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGTSDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 214 - protein, 1371 aa, Lactobacillus buchneri
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDNTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADCDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 215 - protein, 1090 aa, Unknown
  Sphingomonas sp. S17
MDWRLGLDLGANSLGWAALRLDRAGDPIGILAMGSRIFSDGRDPKSGASLAVDRRAARAMRRRRDRFKQRQAALLKYLIRDGLFPADQADRQRLADEDPYALRARALDEELSLFEIGRALFHLNQRRGFQSNRKADRGQDDEAGKIAVGVDRLNQQMEEQGARTLGEFLHQRRRAATDANHIPSVRTRLRPETGEGAKGDGYDFYPSRALIAEEFEEIWAAQAPHYPDTLTQQVHDRLYEIIFHQRPLRAPQVGQCTLVAGETRLPKAHPLFQKRRLLEEINALMIVRPGEIAQRLTPEERDTLYLKLKDKRTVSFATLRKTLKLDSAARFNKESENRTELKGDEVAAELGAKTRLGTRWQHLSGDQQWEVVHRLMALESQADEAAFRDWISQTYDLLPEQAAAVLGARLPQGHGRFGPTATTTLIDSLLHDRTEDGRVVVYSEAVQRSGLGHHSDLRHDRDDEDVTELPYYGVALERHIMPGTAEPTDPEEMRIGRLTNPTVHIGLNQLRHVVNRLIRAYGPPKEIAIELARELKLSEDEKKKRNSENRDNRLAAEGRSKKLEEIRQRDTGANRALLKLWEELNPGNVLDRRCIYTGEQISIDMLFSDRVEVDHILPFAQTLDDSNGNKLLCLREANREKRRRSPYEAWGHTDRWPDIAERASRLPKPKRWRFEPDAMQRFATEDGFLARHLVDTQYLGRLAREYLSWLYPGRGEGSGHVWVSPGRLTEMVRRKLGLNDLLPDHNFGGGADQPKNRLDHRHHAIDALVVAIVDRGMLQAIARASGQDGSEGRERIHIPAPWDGFRDDLRVAVNGIIVSHRPDHGTVAKAGLARGRDQTAGRLHNDTAYGLTGETDAKGNSIVVRRIPLSAIKKPADIARVRDPLLRNALAEFTKGLDGKAFEARIGRFHELGPLLYRGIRRVRVVETLTVIPIRDAEGRAYKGYKGDSNYRYDVWEMPDGKWRCQVVSMFDAHQSTEQARPHPAARKILSLQRNDILAIERTEGDRELVRVVKFSEKQFAVAPPHEGGSLKTRDGNADDPFRYLYPSPNTLKGWRARQVRIDELGRVLDPGFPARKSVRRTRPRAAPVD

SEQ ID NO: 216 - protein, 1000 aa, Kingella kingae
MARAQRRLISRRANRMNKLRRLLKQENVLQANDYDEKGLIIGLPNQAWELRAQGLDRKLEPKEWAAVLINLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQEQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 217 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 218 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 219 - protein, 1126 aa, Lactobacillus farciminis
MADRISLGLDIGVASVGFSVLDIDKGKVIELGARLFSATVAAGNQDRRDMRGARRLLNRNKQRRQDTGKLFKKFGLIDDFDKGSFYDNFNQNLNPYELRVKGLTEQLTKEELAESLYQIVKHRGISYALKDADVDEGGTDYSVSLKINSQELAEKTPAQIQLQRLNDYGKVRGQVVIGDDPDNQKVLLNVFPTSAYEKEAKQIIATQQQFYPESLTDKFTEEYCQILTRKRDYFVGPGNEKSRTDYGIYKTDGRTLDNLFEELIGHDKIYPEELRASAASYTAQLFNVLNDLNNLRILNYEDGKLTKEDKEKIIAEIKNNTTTINMLNVIKKVAGCSKDDIKGFRVNEKDKPEISSMPVYRKIHKDLLKAGVDISDWPVEFIDELSFILTLNTENGEIRKQLNNRLAPKFDFLNADLIQLIIDNKDSFEIKTNNKWHRFSVKTMNKLIPEMMERPVEQMTLLNEMGLVKKDKKRFENNKYLPYKEIAKDIFNPVASKSVREALKIVNAVLKKYGHIDYLVVEMPRDKNLKEEQDNIKEFQNKNKKAKDAAFEAFVKSVGSEQRVKEALSKNRKLQMKMRLWYQQQEIDPYNGKTIDATDLINNPDKFEIDHIIPQSISFYDSINNKTLCFASMNQVKGQKTPYEFMLEGHGQSYDKFKATVMANKNFGKAKRANYLFEENVSDIETRKRFLSRNLVDTRYSSRVVLNSLQDFFREKSADTKVTVIRGKFTSNMRKHWHIDKTRETFHHHAIDASIIAATPFLRMWKKGGTIFPVKVGEESIDIETGEILDDKNFDKAMYEEPYSGFVSEIMNADDRIKFSHQVDKKMNRKVSDATIYSTRTGKLAKDKKDAEYIVAKVKDIYSVDGFKKFKKVYDKDKTKFLLYKYDPRTFSKLERIISDCPDKVEKVQTNGKVKAVDISPFEMYRRDHGMIKKYSKKGNGPAIKQLKYLDKKLGSHIDITPANANGKHVILQSLKPWRTDVYLNHETGEYEIMGIKYSDLKFNKNEGYGIKKDKYLEIKKVEEVSEKSEFMFSLYRKDRVKVQDMKTGESVELLFWSRNFSNKKYAELKPISQAENDKKLPVYGKGRLIKRLIPKNCKIWKVNTTILGDPYYLEKESDSPKDILD

SEQ ID NO: 220 - protein, 1380 aa, Unknown
  Eggerthella sp. YY7918
MNLRHVGNYNIGLDMGTASVGWAAIDEQGELLHFKGKPTWGSRLFDSANTAATARMPRGQRRRYIRRRWRLDLLQKFFSEEMAEKDPEFFIRLRQSSLWPEDREGGHTAYHWPLFNDSDFNEKEYYEKFPTIFHLRQWLMETDEKADIRLIYLAFHNIVKHRGNFLQENNDSLSAQNANMRESLESFCIALEEWCDEKELTCSCDPQKLEHLFKEVKYRSDIRDGFAALLGLACSGENEVDVKAMAKEMGKAIVGYKADFSKIFTECDKEGSSFRLSDDEGPEAFLDICPDDGIALFEAIQMVYSSFILTGMLTEKGLSLSKISAYNQYGQDLESLKALVKEYVPNEYSSFFRGPTYSGSTEYDPSKAQGYTRYNLGPSKKGSGAKPMAYEDFKKSVEQLFANTNAINDERYKEMMGRFAEEKFLRRLRTSDNGRIPFQLNLEEMTAIIINQGKYYPFLLEQQEKLESLVRFRIPYYVGPLTRINARLDSKGNACFAWSKRKDGMDSASIKPWNWDEVIDKHASAQAFIERMTGTCTYLRGEPVLPRCSLLYEEYCVLNELNGARWTQDGDKFIRFDYKDRSDIIEELFKKRRGRIQYAAVADWMKQERSHANVHVSGGQGENAFESRLSSYHFFCNDVFGVDELPGSYVDMVEEIILWSTLFEDRSILREEIQRKYGDVLNEEQIKTICKKRFSGWGRLSRKLLCSLKAQTDNGPKSIMDILQEGDQNNGRVGRAMVFQEILHDEQLGFEQKIEEENTQSMLEGENLLIEDLPGSPAIRRSINQAVRIVDEIVGIAGHAPDNIFIEVTREDDTKKKGKRTTTRYSNIQKALEALKEEGAEALRELKTYKHNELDKRLSLYFMQNGKSLYSGIPLDIRRLSEYQIDHIIPQSYIKDDSYENMALVLPGENQSKADNLLISQDIRIKMKATWTALHKAGLMGDKKYNNLMNSSISDAKMKGFINRQLVETSQSVKLTQMMLSQKYPGAKVRPIKASISSQLRDACDLVKCREANDYHHAHDAYLACQVGRFVLKRHSSMFDNPIGMTKVIRDFVKRQGQEFKRNGKLPAYASRSGFIVQSFMRSGFDAETGELLRDDWNAPFEIARIKRCLNYRDCYISRMPMEDSGAFWDATIYSPKAGKKGALPVKQGLPVEKYGSYSREQFAYFFVYKAYNPKKKAYRLEFEAVPVRVASAVETRENALEEYAKSVAKQAGLEFVEVARPKVYKYQLIELGEDRLYITGKREVRNASQLAFSLDEIDLLKRLAEGEETSSEERERLFDVLIEKYARYAPRLARQLSVDSMSATFETLNAEEQLGILLSLVEIANGKRNMIDLSSAGGSKNAGCMNPTFSSELSSPGSNFTFIDQSVTGMFERRQRLEL

SEQ ID NO: 221 - protein, 1430 aa, Capnocytophaga canimorsus
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSHILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVDKNQQAVLFEEEKTIFELDLEAKQALFNELNLKGNLKAYYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTVNINKAKTEHEKIIKILKNEFGLPNPTRNDIIRYRLYEELKANGYKDLYTNEYIEKQDLFTKNIDIEHIIPKSRVFDDSFSNKTLSFRKTNLDKGERTAFDYIESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVIIDWTKRNDHRHHAMDALTVAFTKHNHIQYLNYLNARKNEKHREHSNIMGIQQLETIKVTDKNGNEKRVFKAPMPNFRQVTKAFLENVLISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLDKNPIWLNKEKGIAIKRVAISGVANAEPLHTKKDHLGKEILDKEGKSIPVDFISTGNNHHVAVYRDEKGNLQEKVVSVFEAVVRANQGLPIIDKTYNQHLGWEFLFTMKQNEMFVFSNESTGFNPNDIDLLDPKNKKIISPNLFRVQKFSKLQYGNSFVREFVFRHHLETTVEDRKELQGITYKQMKNSAFFNDIIKVRINHLGGIVSVGEY

SEQ ID NO: 222 - protein, 1348 aa, Finegoldia magna
MKSEKKYYIGLDVGTNSVGWAVTDEFYNILRAKGKDLWGVRLFEKAKTAADTRTFRSGRRRNDRKGVRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKQQLILLINDLLKIELEEEFMDSIFEILADVNEKKTEKKNILKELINAQDFNKQEGKILYSIFESIVTGKAKIKNIISDEDILEKIKEDNKEDFVLTGDSYEENLQYFEEVLQENITLFNTLKSAYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKYYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPIDTDVKLKLIEELFKKKTKVTLKSIRDYMIRNNFADKEDFDNSEKNLEIVSNMKSYIDFNNILGDKFELEMVEDLIEKITIHTGNKKLLKKYIEETYPDLSSSQIQKIINLKYKDWGRLSRKLLDGITGTNIETGEIDTVINFLRNSSDNLMQIIGSQNYSFNNDIDKLRKKYIPQEISYEVVENLYVSPSVKKMIWQVIRITEEITKVMGYDPDKIFIEMAKSEEGKKTTISRKNKLLALYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYKKSKIIPVKAILASDLRKDMNTLKSREVNDLHHAHDAFLNIVAGDVWNREFTSNPINYVKENREGDKVKYSLSKYFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 223 - protein, 1352 aa, Unknown
  Megasphaera sp. UPII 135-E
MKKRNREEYYVGLDIGTSSVGWAVATPDYRIPKFRGHKMWGSRLFAEGKRAAERRQFRTNRRRLARRRDRLQILEELFAEEMAKVDNTFFMRLKESKFFLEDKTVKEKHILFSTDKFDADRFYKDNPTIYHVRKRLMEEEPQDIRELFLAVHHILKYRGHFLFAGSLEQNGASIEELVRTLLGKQGLAILDDTIDSNEMVNILKNTGETKSDRKKDVQELWNPLKDKVKKAQAAEMAGLVLGLKSDISKLFANSDYKDLDSSIKNINFSSGDYEEKRDDYANSIGDDIVLLDTMKALYDTLILSQILQGKRSISAAKVEDYNTHKEQLRALKAILKPHKRLYNEMFRENNKKDLSNYVAYISSYSEGKRVNREGFYKYVQAVLKQVDDSDSKQAILEAIRLETFLPLLRVKDNAVIPHQIHQAELEAILETARKKYNFLNDVSDGVSVKDKIIQLFTFRIPYYVGPLNPHSGETVADRKQGTGWVVRKQRGKVYPWNFADMVDVKASAEAFITNLTNKCTYLIGEDVLPKRSLLYSEFMLLNELNMIKYDGHELPVAIKQLYIEQVFKQEHKKQTKGRVLDFLKRNGLITGSATAVITGMDDAIKGDLQSYRDMVRIFGAGFDHSMAERIIRWVTLFGEAKDILENKIREVYGNSISDSQMRAIKKLKYADWGRLSQAFLIAVKGCDKSGVERNIITCLRASSQNLMEILSDQGTYIKQIKAWNHQHTTNMMDTLDYQLVDDLYVAPSVKRSIWQSLCIVEELVKIMGQAPKKIFVEVTRTKQAEKTKKDSRKKRLVELYTAIGKEGAAWKKEIEAHQAGDFRRKKLYLYYTQMGRCMYSNEPIAMDALFTSAYDIDHIYPQSLTKDGSWDNLVLVKSQLNKEKSDQYPLRPAIREKNKAHWQYLCRAGFISEKKYERLMRTTELTAEELSGFIARQLVETSQATKAVTGLLERIYTNTEICFVKAETVSQFRHQHNFIKIRELNNYHHAKDAYLNIVVGNVYHEKFTKNPWEFIARSTERRPYNLNRMYDFDLLKQGRVIWQVPKSLETVQAMMKSNDVRITKKLLVQKGELYDATITKAHKAKEGTYFPLKGADARLRDVHRYGGYEKIKIAYYSVFSCREKASNTIHTLIIPIPVYKAGLLQTEADLTAYAWQTKQKTKPIKDIYSAITPIYKKLCINTVVKIDGFKYFLGGKTGDYMWLDPAIPVVLDEQAAAYLKAISKVGRADDVENTAQAIDLITAEANEAFYDVLLKKMEAKIFAKAYQTIVEKLASETARERFRELSIGAQCSCLLEILNLLANNKTTFTFFKDKMGVTMSRRKQPMDLTKLEECIVYETSITGLYEKAVSLL

SEQ ID NO: 224 - protein, 650 aa, Haemophilus pittmaniae
MENKNLHYILGLDLGIASVGWAVVEIDKEENPLCLIDVGVRTFERAEVPKTGESLALSRRLARSARRLTQRRVARLKKAKRLLKLENILLSTDERLPHQVWQLRVEGLDRKLKRQEWAAVLLHLIKHRGYLSQRKNESKSENKELGALLSGVASNHELLQQTTYRTPAELAVKKFEVEEGHIRNQQGAYTHTFSRLDLLAEMELLFSRQQHFGNPFASEKLLENLTALLMWQKPALSGEAILKMLGKCTFEDEYKAAKNTYTAERFVWITKLNNLRIQENGLERALNDNERLILIEQPYEKAKLTYAQVRSILNLSDEAIFKGLRYSGEDKKAIETKTTLMEMKAYHQIRKVLEGNNLKAEWTELKENSTLLDEIGTAFSLYKTDEDISTYLAGKLSQPVLNALLENLSFDKFIQLSLKALYKLLPLMQQGLRYDEACHEMYGDHYGKKTYGKKTEENHYFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKNNAS

SEQ ID NO: 225 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 226 - protein, 1052 aa, Haemophilus parainfluenzae
MENKNLHYILGLDLGIASVGWAVVEIDEKENPLRLIDVGVRTFERAETQKGESLALSRRSARSARRLTQRRVARLKKAKRLLKSENILLSTDERLPHQVWQLRVEGLDRKLERQEWAAVLLHLIKHRGYLSQRKNESKSENKELGALLSGVASNHELLQQATYRTPAELAVKKFEVEEGHIRNQQGAYTHTFSRLDLLAEMELLFSRQQHFGNPFASEKLLENLTALLMWQKPALSGEDILKMLGKCTFEDEYKAAKNTYTAERFVWITKLNNLRIQENGLERALSDNERLMLIEQPYEKAKLTYAQVRSILNLSDDAIFKGVRYSGEDKKAIETKTTLMEMKAYHQIRKVLEGNNLKAEWVALKANPTLLDEIGTAFSLYKTDEDISAYLAGKLSQPVLNALLENLSFDKFIQLSLKALYKLLPLMQQGLRYDEACREIYGDHYGKKTEETHHFLPQIPADEIRNPVVLRTLTQARKVINGVVRLYGSPARIHIETGREVGKSYKDRHELKKRQEENRKQREKTISEIKTLFPNFSGEPKGKDILKMRLYYQQNAKCLYSGKPLELHRLFEQKYVEVDHALPLSRTWDDSFNNKVLVLANENQNKGNLTPFEWLDGKNNSERWRTFKALVETSAFPYAKKQRILSQKLDEKGFIERNLNDTRYVARFLCNFIADNMHLTGEGKRKVFASNGQITALLRRRWGLAKSREDNDRHHALDAVLVACSTVAMQQKITRFVRFKAGDVFTGERIDRETGEIIPLHFPTPWQFFKQEVEIRIFSDNPKLELENRLPDRPQANHEFVQPLFVSRMPTRKMTGQGHMETVKSAKRLNEGISMIKMPLTKLKLKDLELMVNREREKDLYDALKTRLEAFNDDPAKAFAEPFMKKGGAIVKSVRVEQVQKSGVLVRQGNGVADNASMVRVDVFTKDGKYFLVPIYTWQVAKGILPNKAVIQGKDEEDWEDIDDATFQFSLHPNDLISVKTKKDEFLGYFNGLNRHTGGINIRTHDLEKSKGKQGIFEGIGVKIALSFEKYQIDELGKNIRLCKPSKRQPVR

SEQ ID NO: 227 - protein, 1331 aa, Lactobacillus sanfranciscensis
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 228 - protein, 1473 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHNQFTAFVEGIDFKVLPSGKFEKI

SEQ ID NO: 229 - protein, 933 aa, Mycoplasma iowae
SVRDYSDGPGSEKSPTPYGLWRLNKEGKVEKIGENLWDVLVGKCTIYGNDDSIKDEKTKLRGGKNSPIAEVFNFINDLTNIYLFSSSKLKLNSKTKLSILDEFNISLKTSKPIKSFSEKKLVKHIISTTEFKDINFDDVYGYRIDTSKKPLFTKLENTITIAKWLLDNNVYNELNIYDQEDLIKINNIFVILQKSMDINKRAQLVSDEYKIDLPICLELVKKIKGVMQTHSFSYKAMLEYIPVGIKYNDLETGEDTSINASTYFVDKINNLNTKLLFNGRPRKYIPKNIFEDGIISPTSKRAFIQTINVLNKIIKVYSKDYDIDNIAIELPRDKNTAEERKKISSNQKKAGEEIAEVLKFAGLNVEEYTSKLNSKTKLKLKLLKEQNYKDIYDGQEIDVIDVIKNSNKYHEEHIIPYSLCFIDSRRNKVLTKFENNKQKGNKTPFQWLSSIGKYAEFKDRVEKLFVEQKISKAKKELLLFEQDPRTEMLGFIEKNLSDTRYASKLVFDTFRDFFKVNNPNVKIKVINGALTNYARYNLFATYKDGLLERKGIMKQREFYEHHGIDATILAFLGSNHKINQLLKLSHKFKKQDDNKIYDENTGELIEFTKDFLSDEARKKAMELSKQIFEIPCKFSRPIYRKSNVSFSNETLISMKWIDDKYTKGVKINKLSLVNKDLDLNEYFADYETNEMKNLICYQEDKTLYNKLKNIYDKYNNFVENSNIKPVKNPFINYMISNFSSDDSKIQNFKHIIFYDHKGNKKFVKSLKVCGDEKNLSNIVLRKDQKDIMNSKKIKKSGILESLNPISARIYKDNKGKYITIPINSLVLNWTKKGLEIDNEKLCNILKSKNIFNNQFIEINAGQSIINNENKLFYFVGGGDFKVNKLEIKSQFCDNEIFFPRKQMNISIATIIDNYKLCEVDELGKIYNIRKIVL

SEQ ID NO: 230 - protein, 1358 aa, Acidaminococcus intestini; identical to SEQ ID NO: 94

SEQ ID NO: 231 - protein, 983 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 232 - protein, 1338 aa, Streptococcus macacae
MTKPYSIGLDIGTNSVGWAVVTDGYKVPAKKMKVLGNTDKSHIKKNLLGALLFDSGNTAKDRRLKRTARRRYTRRRNRILYLQEIFAEEMAKADESFFQRLNESFLTNDDKEFDSHPIFGNKAEEEAHHHKFPTIFHLRKHLADSTEKSDLRLIYLALAHMIKFRGHFLIEGQLKAENTNVQTLFDDFVEVYDKTVEESHLSEISVSSILTEKISKSRRLENLIKYYPTEKKNTLFGNLIALSLGLQPNFKTNFKLSEDAKLQFSKDTYEEDLGELLGKIGDNYADLFISAKNLYDAILLSGILTIDDNTTKAPLSASMIKRYEEHQEDLAQLKKFIRQNLPDQYSEVFSDKTKDGYAGYIDGKTNQEAFYKYIKNMLSKTEGADYFLDKIDREDFLRKQRTFDNGSVPHQIHLQEMHAILRRQGEYYPFLKENQDKIEKILTFRIPYYVGPLARKGSRFAWAEYKADKKVTPWNFDDILDKEKSAEEFITRMTLNDLYLPEEKVLPKHSLVYETFNVYNELTKVKYVNEQGKAIFFDANMKQEIFDHVFKENRKVTKDKLLNYLNKEFEEFRIVNLTGLDKENKAFNSSLGTYHDLRKILDKSFLDDKVNEKIIEDIIQTLTLFEDREMIRQRLQKYSDIFTTQQLKKLERRHYTGWGRLSAKLINGIRDKQSNKTILGYLIDDGYSNRNFMQLINDDSLPFKEEIARAQVIGETDDLNQLVSDIAGSPAIKKGILQSLKIVDELVKVMGHNPANIVIEMARENQTTAKGRRSSQQRYKRLEEAIKNLDHDLNHKILKEHPTDNQALQNDRLFLYYLQNGRDMYTEDPLDINRLSDYDIDHIIPQSFIKDDSIDNKVLVSSAKNRGKSDNVPSEDVVNRMRPFWNKLLSCGLISQRKYSNLTKKELKPDDKAGFIKRQLVETRQITKHVAQILDARFNTKRDENKKVIRDVKIITLKSNLVSQFRKDFKFYKVREINDYHHAHDAYLNAVIGKALLDVYPQLEPEFVYGEYPHFHGYKENKATAKKFFYSNIMNFFKKDDIRTDENGEIVWKKDEHISNIKRVLSYPQVNIVKKVEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 233 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 234 - protein, 1535 aa, Flavobacterium columnare
MTKILGLDLGTNSIGWAIRDTENEGINQILDKGARIFSEGVKSENGKEISRAAERTAYRSARKIKYRRKLRKYETLKVLSINGMCPLSVEEVEQWKKSGFKEYPLNPEFLDWLRTNEDKNINPYLFRDKASKQKVTLFELGRALYHIAQRRGFLSNRLDQSAEGVFEEHNPQIQNLIEDLDSSNTILNELKEYYINLGIIDETEKSGFKKDLDEGEKKLKSLYNSLVAITKKNANDIETCKQELIARLNKKEDLGKVKGKIKDISQAMLDRNFKTLGQYFFSLYNKERIRNQYTSREEHYLEEFIIICQTQGIEGINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKSDFNFEVLAKELVEKGASFGYYKSSKKNEFFYWFNYKPTDSVSACVVSASLENAIGKDWKIKTFEYQTRNTEKNEVTKSVDYKDLWHLLSVATSDTYLYDFAIEKLKLEPKNAKAFSKTKLKKDFASLSLAAIAKILPYLKQGLLYSHAVFMANIENIVDADIWKDEEQQKFIQSKIVELVDNYIVEKSKLELINGLLKIYNTEDKEGRKVYYSKEAESLFEADLRKKLVPFYKANIIIEEHEQEIIFQDLFPILMDQLKKQEFIKIGRLDKQIEAFLEGENEEGQIFCNHTDKLKKLYHPSDIEVFKKKTIKDEWGNEKVVLGSPLTTSIKNPMAMRALHQLRKVLNTLIANDQIDEDTRIHIEMARELNDANKRKGIQDFQNENKKFREEAIKEIKKLYLEECHKDVNPTEDDILRYQLWLEQGKCEIYEEGNNISICDIIGSNPSYDIEHTIPRSISQDNSQMNKTLCSLKFNRSIKKQKMPVELSNYNDILPRIAHWKKEAEELTRQIETISRSIKSAATKVAKDKNIRKRHYLTLKRDYILGKYERFTWEEPKVGFKNSQIPDTGIITKYAQAYLKSYFKRVESVKGGAVAEFRKLWGIQESFIDENWWKHYKDKDRDKHTHHTIDAITIACMPKDKYDLLAHAWRLEDEQDKKAAKVLIEQAKPWKTFKEDIEKIETEILVSHFTPDNVKKQSKSIIKNRGKKVYVLKNELPVNFKNKIEGKDYFKLKFDSKILYKIPKKKEKQTDTFYEELPKNYLNGVEGKDYFKINTTGKTFYKIPIFNQGDTIRGSLHQETTYGAIKLPDIDIETKKPLHTDKGGFILKKDIKGNEIVFFVVRKEISKISENDVQNIVDNVVRKKIENAIANSLITFKIVKKKKVAVIKEGVTIWMREPNIEKGIEGIPIKKVRIITNSVKNPIEIKVHSPLSKSRHKHKQKVYGQNDENYAMALYELDGKREFELINNFNLAKLLKQSQSYYPLHKEKEIKGKKILVPIEKRNNKDVILKRGQQVVFYDKTVENPKDISEIIDFRERIYIIEGLTIQRQKDKKTSKVNEYGIIQLRHFKEARKSEEISKDNFKPDGEFKINENKPTRKMNHNQFTAFVEGIDFKVLPSGKFQKI

SEQ ID NO: 235 - protein, 1459 aa, Flavobacterium columnare
MKFNLGLDIGTNSIGWALVNEDYENKKGKIIAAGSRIIPMTQDILDKFGSGAITETQTALRTDYRSKRKLIQRFLLRRERLHRVLNVLDFLPKHYAESIDFEKYFGKFLPNTEPKLAYNQNQFIFQNSFLEMLKEFQEKHPELLTNNKKIPYDWTIYYLRKKALNQRIEKEELAWLLLQFNQKRGYNQLRDEEEESVPNKQVEFYSLKIIDVVADQPKEGRDKRWYSINLENGWTYRRESKTPLFNWEGKTKDFIVTTDLNQDGSIKKDKEGKEKRSFRAPSEGDWTLLKKKTEKEIYESGKTLGTYIYDALLNTPDLKIKGDFIRTIDRSIYKEELQQIINKQKEYHLELNSSKLYKACLEELYPKNEIYKSALKNKDIAYLFINDILYYQRPLKAPKYNIGKCTYESRTFKKEDKKIREYIPAVAKSHPLFQEFRLWQWIKNLKIYEKLSSDNCTDFFLTNEQDFENLFEFLWNKKEIDHKGILEYLVKTKFPDLKPKQVKTKVKEYRWNYVYDHEKDESKTYPCGETYFLLKNKLDKIYNAQDDFLDKERLYNLWHIIYSVTDKKQYEKALAKFALKNHLDTKSFVNTFKRIPPFKNDYAIYSLKAIKKLLPLMRVGKYWNYDDIDPITKQKIQCIITGEENDTISTLVREKTNHFSNENDFKNLPLWLAGYIVYNSHNESSEIEKWKSPQDIDTFLKKFKQHALRNPIVEQVVTETLRVVRDIWSKKGQGKKDFFNEIHIELGKDLKNPVDKRRKLSSTNTKNESTNTRIKALLIELFTQGVENVKPNSPKHQEILKIFEEGALNSGIEIEEDIIKISNTDQPTKKQLELYILWLEHKYKSPYTGQSIPLSKLFTPNYEIEHIIPRSKYYDDNLSNKVICETEINRLKNNQLGYEFINNHEIREVTLEEGKTIRLLSPEQYWNFVTTYYAKNKAKRENLLLKELPVQMVEKQLNDTRYVSKYVMQLLSKIVRKEDGTDNGINSTNILSISGKMTRALKNDWDLNDVWNDLLLYRFERLNTITKTNLFTTYSEQKQKRMPIVPDQYAKGFHKKRLDHRHHALDAIVIACITRNHINYMNNQNIQGEKLKKNAIEKENYREILQKSRLDIRAQLCEKKYNDNDPTKYNWVFIKPWADFTENTKDILESIIPSFKQNLRIINKTVNYYEKYNENGKKVKVRQIKGDNWAIRKPLHKETISGKVHLSYKTPAKGKILTATRKVLDSSMDFKSIEKITDTGIQKILKNYLEYKKSPELAFSPEGIEELNATITKYNNGFHHKPIYKVRIYEEGVKFPLGNKGNKKSKYVEAEKGTNLFFAIYKDQENNRYFETIPFNDVLETLKKGMSAVPEKNQEENTLVFALSPQDLVFVPTLDEIENPDIVDFKNLTKDQTNRIYKMVSSSGKQCFFIKAEVATSIVNKMEFSTSNKMENSIEGIQIKSNCWKLKLDRLGTITRVIK

SEQ ID NO: 236 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 237 - protein, 1425 aa, Prevotella micans
MIQKIFGLDLGTNSIGSSVRNLELGENLTEQLEFFSSDIFGSSVSKNSNGREYSLAGNRSAHRRSRGLNEARRRKLWATLDLLIEHGLCPMSPDSLMQWRTYDKQKGLYRQYPIEDKDFNAWIMLDFNGDGKPDYSSPYQLRRELVVRQFDFDQPIERYKLGRALYHIAQHRGFKSSKGETIADQEKNEKKPIAEEGADIANEMKASETKLSKGLVAYMQENHLKTVGEAFAKLEDERVRIRNNESYRAIRSQYQDEIKEIFTYQKKLSVESELYERLTSEKKGVGTIFYKRPLRSQRGNVGKCTLERNKPRCPIGRPEFEEFRAWTLINNIKIRETAGEPYKQLPIKLRQELLKDCFLSKVKADFKFEDIRKYIEKRLGLSFSNDDKTINYKDSVSIAACPVTVRMKKLLGENWANCRIDGEKRRQAHGKNNNNEHIVSYTEEDIWHVCYNAEDPEEVSNFARKALHWDENKIKELVRLWTSIPQGYAMLSLKAIRNINRMLLLGLKYSDAVLLAKLPDIVPVSDEDILAITKEFLQLEDKLNQEKQINNIVNSLIANYKSKLEENRFADHNYQYQLGEGDDEDINTQIKSHIGAKLWVQIGADEQTKIFQAVRSKYQDFFKSYKRKFVESPKLGELLVAFLTEKFPNVKSKQWERLYHPSQIAIYRPIPVDNDRSKLRLGNPNIGAIKNPTVMRVLNTLRRRVNQLLDDGVISPDETRVVVETARELNDANTKWALDRYNRIRRDENEKIRKILKELNPTTNSISEQDIDKARYIFEQCETDFYTDGKVPYYNKDIKKYKLWLEQGGQCLYTGQTINLTNLFNPNAFDMEHTIPKSISFDNSDQNLTLCESYYNRFIKKNNIPTDMPNYDKDVTINGKEYTAIKPRLQRWKERVDRLSRNVDFWKGQARRAQDKDRKDECIREKHLWDMELAYWKGKLERFTMTDVTDGFKNSQLVDTRVITRHAVLYLKSIFNHVEVQRGETTAEFRKILGLQSIDEKKDRSLHSHHAIDATMLTVIPSAAKRDRMLELFYKIEETKKALKNYNDNNKTGLNLELKGLEEKLDKEKKDCRVGRRVNDLDRFINENIIVSHHTKDQALTPAHRRLRKRGKIVGGKEHPRWQTGDSLRGEIHKASYYGAITQFAKDANGKVLMKDGQAQIDPTIYYVIRRELKYKRSTQDSGFTNWEDLEKVIVDTDLFGLMKGQFPEGTSFKDACEQGFYMIKKGKNGEGDVKTHRIRHVRCKAVKTALRIKEQTYKSSKDYKQFFYAAVGDLYVMCYYTDGKKRDFKIYSLYDISNHRKSGTEDIPKFITDKKGNHLPLDYKLRTGDMVLLYKDNPEELKDLDQVNLKRRLYKVNRFESEGLIILLTHHLSTTTERGCSIGKIENYQNLPTAIRCGIKTIKFLIMGKHRDFVIRNGNIEFKH

SEQ ID NO: 238 - protein, 1473 aa, Mucilaginibacter paludis
MKNILGLDLGTNSIGWALIEKDTDQKNGNILGTGSRIIPMSQDIKDEFGKGNSISQTADRTKFRSVRRLRERHLLRRERLHRVLNVLGFLPKHYADQIDFKKRLGKLVNETEPKLVYDNKNFIFKKSFEAMLSDFNQHQPLLLADGKKVPFDWTIYYLRKKALTEKIEKEELAWLILNFNQKRGYYQLRGEEEEENPNKMVAFHSLKIVEVIADESQKGKAETWYSLILENGWIYRRSSKTPLYDWKGKQRDFIVTTDLNDDGSIKTDKEGLEKRSFRAPVEDDWTLVKKKTEQEINRSHKTVGTYIYENLLQDPKQKIKGKLVRTIEREFYKDELKMILKNQQKFHPELNDEHLYINCVRELYRNNQAHQTILSKKDFVHLFIDDIIFYQRPLRSQKSSISNCTLEFRKYKNENGTDQTDYLKAIPKSHPLFQEFRLWQWIYNLGIYQKEDDTNVTDELIKNIDGYQDLFDFLNNKKEIRQDILIKFLVEQTGLKGKPLSSVVAKYRWNFVEDKIYPCNETGTQIRTRLAKVENTPEDFLTAETEIKLWHIIYSVNDKADYEKALKTFAEKHNLDTHSFVENFKKFPPFKSEYGSFSEKAIKKLLPLIRLGKYWSWENIDKKTQERIEKILTGEFDEAIKSRVRDKAIHLTEEDHFQGLQLWLASYVVYGRHSEADNLDKWHTVADLEDYLAEFRQHSLRNPIVEQVITETLRVVKDIWLQYGQGAKDFFSEIHIELAREMKNTGDERKRLTSLVTDNENTNLRIKVLLSELLNDGNVENVRPYSPMQQEALKIFEDGVLNSDIEIEDDILKISKMAQPTNTELKRYKLWLEQKYRSPYTGQIIPLNRLFTADYEIEHIIPQSRFFDDSFSNKIICESAVNQLKDKQLGLEFIKNHSGTIVKLGMGKTAKILDVESYNEFVKGNYTKNISKRNKLMLEEIPDKMIERQLNDTRYISKFIISALSNIVRSESNDDGFNSKNVLPGNGKITSRLKQDWGMNDIWNELILPRFERMNKITDSAVFTAWNENNQKFLPIVPLEFSKGFQKKRIDHRHHALDALVIAASTREHINLLNNEHAKSDKRFDLNRKLRKFEKVAYNDPKTGKRIEKEVPTIFLKPWETFTVDAKNSLESIIVSFKQNLRVINRATNYSESYNDENGALRLGKDGNPLKEKIKQSKGDSWAIRKPMHKDFVYGKVHLQNVKLPKDKFITAIRKSLDVTFDLKRIETITDTGIQKILKNYLHSKENKVELAFSPEGIEDMNQHIERYNDGKKHQPIHKVRVFEIGSRFSLGESGNKKTKFVEAAKGTNLFFAVYQDDNKGKRNYETIPLNIVIERQKLGLHSVPTEDAKGGKLLFHLSPNDMVYVPTSEELEDNLASVNIKRLNTAQRKRIYKVEKASGVECYFIRQDIAYLIKNYDAKTKIGELESQNKLQTTMTDDRLKITDVCVKLNIDRLGSIAETFLGNQYGASKKT

SEQ ID NO: 239 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 240 - protein, 1130 aa, Streptococcus macedonicus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVPTETGKLSTEQKESLVEFAKNTAILGPAKLLKEIAKILDCKVDEIKGYREDDKGKPDLHTFEPYRKLKFNLDSVNIDYLSREVLDKLADILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFINKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKSLNKPNISIYKVRTDVLGNKYFVKKEGDKPKLDFKNNKK

SEQ ID NO: 241 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 242 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 243 - protein, 1375 aa, Lactobacillus johnsonii
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGQLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKAIFNKTRKFSFISQLLKNKSENSKEIAKKLKRAYQFKYMLVSRETETRDQEMFKMTVYPRFSHDTVKAPRNLIPKKMGMSPDIYGGYTNNSDAYMVIVRIDKKKGTEYKILGIPTRELVNLKKAEKEDHYKSYLKEILTPRILYNKNGKRDKKITSFEIVKSKIPYKQVIQDGDKKFMLGSSTYVYNAKQLTLSTESMKAITNNFDKDSDENDALIKAYDEILDKVDKYLPLFDINKFREKLHSGREKFIKLSLEDKKDTILKVLEGLHDNAVMTKIPTIGLSTPLGFMQFPNGVILSENAKLIYQSPTGLFKKSVKISDL

SEQ ID NO: 244 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 245 - protein, 1063 aa, Simonsiella muelleri
MEKFHYVLGLDLGIASVGWAAIEIDKETETSIGLLDCGVRTFERAEVPKTGDSLAKARREARSTRRLIRRRSHRLLRLKRLLKREIFRQPETFKDLPINAWQLRVKGLDSRLNEYEWAAVLLHLVKHRGYLSQRKSEMSETDSKSEMGRLLAGVAENHQLLQQEQYRTPAELALKKFVKHFRNKGGDYAHTFNRLDLQAELHLLFQKQRELGNPFTSPELERQVDDLLMTQRSALQGDAILKMLGHCGFEPEQFKAAKNTFSAERFIWLTKLNNLRIQDQGKERALTADERTKLLDEPYKKSKLTYAQVRKLLSLPQTAIFKGLRYDLEHDKKAENSTLMEMKSYHNIRQTLEKSGLKTEWQSIATQPEILDAIGTAFSIYKTDEDISHELKTCRLPENVLNELLKNINFDGFIQLSLTALRKILPLMEQGYRYDEACTQIYGNHHSGSLQQESKQFLPHIPIDDVRNPVVFRTLTQARKVVNAIIRRYGSPARVHIEMARELGKSKSDRDRIEKQQQKNKKERENAVAKFKEDFPDFVGEPRGKDILKMRLYEQQHGKCLYSGHDIDINRLNEKGYVEIDHALPFSRTWDDSQNNKVLVLGSENQNKRNQTPDEYLDGANNSQRWLEFQARVQTCHFSYGKKQRIQLAKLDDETEKGFLERNLNDTRYIARFMCQFVQENLYLTGKGKRLVFASNGGMTATLRNLWGLRKVREDNDRHHALDAIVVACSTASMQQKITKAFQRHESIEYVDTETGEVKFRIPQPWDFFRQEVMIRVFSDQPCEDLVEKLSARPEALHDNVTPLFVSRAPNRKMSGQGHLETIKSAKRLSEENSMVKKPLTTLKLKDIPEIVGYPSREPQLYAALKTRLETHDDDPIKAFAKPFYKPNKNGELGALVRSVRVKGVQNTGVMVHDGKGIADNATMVRVDVYTKAGKNYLVPVYVWQVAQGILPNRAVTSGKSEADWDLIDESFEFKFSLSRGDLVEMISNKGRIFGYYNGLDRANGSIGIREHDLEKSKGKDGVHRVGVKTATAFNKYHVDPLGKEIHRCSSEPRPTLKIKSKK

SEQ ID NO: 246 - protein, 1509 aa, Psychroflexus torquis
MKRILGLDLGTNSIGWSLIEHDFKNKQGQIEGLGVRIIPMSQEILGKFDAGQSISQTADRTKYRGVRRLYQRDNLRRERLHRVLKILDFLPKHYSESIDFQDKVGQFKPKQEVKLNYRKNEKNKHEFVFMNSFIEMVSEFKNAQPELFYNKGNGEETKIPYDWTLYYLRKKALTQQITKEELAWLILNFNQKRGYYQLRGEDIDEDKNKKYMQLKVNNLIDSGAKVKGKVLYNVIFDNGWKYEKQIVNKDEWEGRTKEFIITTKTLKNGNIKRTYKAVDSEIDWAAIKAKTEQDINKANKTVGEYIYESLLDNPSQKIRGKLVKTIERKFYKEEFEKLLSKQIELQPELFNESLYKACIKELYPRNENHQSNNKKQGFEYLFTEDIIFYQRPLKSQKSNISGCQFEHKIYKQKNKKTGKLELIKEPIKTISRSHPLFQEFRIWQWLQNLKIYNKEKIENGKLEDVTTQLLPNNEAYVTLFDFLNTKKELEQKQFIEYFVKKKLIDKKEKEHFRWNFVEDKKYPFSETRAQFLSRLAKVKGIKNTEDFLNKNTQVGSKENSPFIKRIEQLWHIIYSVSDLKEYEKALEKFAEKHNLEKDSFLKNFKKFPPFVSDYASYSKKAISKLLPIMRMGKYWSESAVPTQVKERSLSIMERVKVLPLKEGYSDKDLADLLSRVSDDDIPKQLIKSFISFKDKNPLKGLNTYQANYLVYGRHSETGDIQHWKTPEDIDRYLNNFKQHSLRNPIVEQVVMETLRVVRDIWEHYGNNEKDFFKEIHVELGREMKSPAGKREKLSQRNTENENTNHRIREVLKELMNDASVEGGVRDYSPSQQEILKLYEEGIYQNPNTNYLKVDEDEILKIRKKNNPTQKEIQRYKLWLEQGYISPYTGKIIPLTKLFTHEYQIEHIIPQSRYYDNSLGNKIICESEVNEDKDNKTAYEYLKVEKGSIVFGHKLLNLDEYEAHVNKYFKKNKTKLKNLLSEDIPEGFINRQLNDSRYISKLVKGLLSNIVRENGEQEATSKNLIPVTGVVTSKLKQDWGLNDKWNEIIAPRFKRLNKLTNSNDFGFWDNDINAFRIQVPDSLIKGFSKKRIDHRHHALDALVVACTSRNHTHYLSALNAENKNYSLRDKLVIKNENGDYTKTFQIPWQGFTIEAKNNLEKTVVSFKKNLRVINKTNNKFWSYKDENGNLNLGKDGKPKKKLRKQTKGYNWAIRKPLHKETVSGIYNINAPKNKIATSVRTLLTEIKNEKHLAKITDLRIRETILPNHLKHYLNNKGEANFSEAFSQGGIEDLNKKITTLNEGKKHQPIYRVKIFEVGSKFSISEDENSAKSKKYVEAAKGTNLFFAIYLDEENKKRNYETIPLNEVITHQKQVAGFPKSERLSVQPDSQKGTFLFTLSPNDLVYVPNNEELENRDLFNLGNLNVEQISRIYKFTDSSDKTCNFIPFQVSKLIFNLKKKEQKKLDVDFIIQNEFGLGSPQSKNQKSIDDVMIKEKCIKLKIDRLGNISKA

SEQ ID NO: 247 - protein, 1112 aa, Staphylococcus simulans
MLVGLKFKQSILFENMENAEDIKESATGSDAISLSDDYYENLSEFLTDEQLNFIESANTFFMGIMLDRILKGATSISAAKVRDYKIFKSQLKLIKDIVYQNKYDKYHEFFVTSKEDMRAYQENPDAKNFGKLSKFDQYLIHSKDQYAKLMKDLKGLVPKEYTEVLNLIDEQKFLVVQNTTDNASIPYQNNVFEAENILRNQQKYYPEITEEMIGKVINLISFRIPYYVGPLTNKNGQSDFAWMIRKSDEQTLPWNFDKVIDKSKSAEKFIRRMTSKCTYLLEEDVLPKHSLLYQEMEVLNELNNVQLRGENEPKHRIHRLDPKVKQFIYHNLFQKKKNVTHKDLITLLQNSEHRNTLNKTSGQKLKVFGTQNDSKFASKLSTYNDMKAILGSVENKRQMIEELVLWITIFEDKAILKQKIGEKYPNITEKQLNQIVKLNYSGWGRLSEKLLTKEVNGRSLIDLMYSTENNFMEIITDKTLGFDCFIKNSNKVKNAKISYKDVAELRTSPALKKGIWNAIKMVREISNLFGAPEKIIIEFATEDQAKGKRQKSRSELWDDLVKKNNLKRNKEFEGLFEELKAYPDLDFSNPKLWLYIHQNGKCMYTKKPIDLERLMSDTNNQLYEIDHILPRTFVKDDSINNKVLVIQSANQKKSGDKMPLEIFDNHVLVPFWKMLYENDLISSSKLSKLMKKEFNDLDKEGFIQRQLVETRQIISHVSDFLTEEYPSTTVVPMKANVVSELRRKFDIPKIRQLNDWHHAVDAYLNGFVYQAARVFYPKVNLFEFNFKWEKVREKWRQLGEFTENNKKREFFLFKRMENYVNEYGEGMISKLIFDLDNFKFNYSRKVESTESAFYKQSAFSPKNTTAQYDSDKNKTAIYKEMKNKRGIVVSYTYVKKDQELIGYGVFNETVFEYVNNADVDMNTRALKIVRKAFPKLDIKKAQYLFSINKGDALLVNGHPFLFVSAYERINGKQLEFDIAMQRKIKQALSPYNNMTEQEKVEFYNQFAEKVIEEFRNSIGLQSRDRKVNLIKNLFNNTEKSNDSMTQSILEVLKMTKVSAERSKELKIRWNGQTPNTFIDTKNNAEIQYKSITGLKTTKPKSIFKLAESKNEL

SEQ ID NO: 248 - protein, 1274 aa, Mycoplasma gallisept
MNINMNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 249 - protein, 1122 aa, Artificial Sequence; identical to SEQ ID NO: 18
  Synthetic amino acid sequence

SEQ ID NO: 250 - protein, 1236 aa, Artificial Sequence; identical to SEQ ID NO: 16
  Synthetic amino acid sequence

SEQ ID NO: 251 - protein, 1059 aa, Artificial Sequence; identical to SEQ ID NO: 10
  Synthetic amino acid sequence

SEQ ID NO: 252 - protein, 1166 aa, Artificial Sequence; identical to SEQ ID NO: 34
  Synthetic amino acid sequence

SEQ ID NO: 253 - protein, 1149 aa, Artificial Sequence; identical to SEQ ID NO: 32
  Synthetic amino acid sequence

SEQ ID NO: 254 - protein, 1314 aa, Artificial Sequence; identical to SEQ ID NO: 22
  Synthetic amino acid sequence

SEQ ID NO: 255 - protein, 1064 aa, Artificial Sequence; identical to SEQ ID NO: 33
  Synthetic amino acid sequence

SEQ ID NO: 256 - protein, 1401 aa, Artificial Sequence
  Synthetic amino acid sequence
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAYPYDVPDYASLGSGSPKKKRKVEDPKKKRKVD

SEQ ID NO: 257 - protein, 1368 aa, Artificial Sequence
  Synthetic amino acid sequence
MDKKYSIGLAIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 258 - protein, 1368 aa, Artificial Sequence
  Synthetic amino acid sequence
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 259 - protein, 1368 aa, Artificial Sequence
  Synthetic amino acid sequence
MDKKYSIGLAIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 260 - protein, 15 aa, Artificial Sequence
  Synthetic amino acid sequence
IGLDIGTNSVGWAVI

SEQ ID NO: 261 - protein, 8 aa, Artificial Sequence
  Synthetic amino acid sequence
IVIEMARE

SEQ ID NO: 262 - protein, 27 aa, Artificial Sequence
  Synthetic amino acid sequence
DVDHIVPQSFLKDDSIDNKVLTRSDKN

SEQ ID NO: 263 - protein, 8 aa, Artificial Sequence
  Synthetic amino acid sequence
HHAHDAYL

SEQ ID NO: 264 - protein, 11 aa, Artificial Sequence
  Synthetic amino acid sequence
YGRKKRRQRRR

SEQ ID NO: 265 - protein, 12 aa, Artificial Sequence
  Synthetic amino acid sequence
RRQRRTSKLMKR

SEQ ID NO: 266 - protein, 27 aa, Artificial Sequence
  Synthetic amino acid sequence
GWTLNSAGYLLGKINLKALAALAKKIL

SEQ ID NO: 267 - protein, 33 aa, Artificial Sequence
  Synthetic amino acid sequence
KALAWEAKLAKALAKALAKHLAKALAKALKCEA

SEQ ID NO: 268 - protein, 16 aa, Artificial Sequence
  Synthetic amino acid sequence
RQIKIWFQNRRMKWKK

SEQ ID NO: 269 - protein, 9 aa, Artificial Sequence
  Synthetic amino acid sequence
RKKRRQRRR

SEQ ID NO: 270 - protein, 8 aa, Artificial Sequence
  Synthetic amino acid sequence
RKKRRQRR

SEQ ID NO: 271 - protein, 11 aa, Artificial Sequence
  Synthetic amino acid sequence
YARAAARQARA

SEQ ID NO: 272 - protein, 11 aa, Artificial Sequence
  Synthetic amino acid sequence
THRLPRRRRRR

SEQ ID NO: 273 - protein, 11 aa, Artificial Sequence
  Synthetic amino acid sequence
GGRRARRRRRR

SEQ ID NO: 274 - protein, 13 aa, Artificial Sequence
  Synthetic amino acid sequence
DAYPYDVPDYASL

SEQ ID NO: 275 - protein, 17 aa, Artificial Sequence
  Synthetic amino acid sequence
PKKKRKVEDPKKKRKVD

SEQ ID NO: 276 - DNA, 4206 bp, Artificial Sequence
  Synthetic nucleic acid sequence
atggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggactga

SEQ ID NO: 277 - protein, 1401 aa, Artificial Sequence; identical to SEQ ID NO: 256
  Synthetic amino acid sequence

SEQ ID NO: 278 - DNA, 50 bp, Artificial Sequence
  Synthetic nucleic acid sequence
ttatatgaacataactcaatttgtaaaaaagggtattggggaattcatta

SEQ ID NO: 279 - DNA, 50 bp, Artificial Sequence
  Synthetic nucleic acid sequence
taatgaattccccaatacccttttttacaaattgagttatgttcatataa

SEQ ID NO: 280 - RNA, 42 nt, Artificial Sequence
  Synthetic nucleic acid sequence
auaacucaauuuguaaaaaaguuuuagagcuaugcuguuuug

SEQ ID NO: 281 - DNA, 27 bp, Artificial Sequence
  Synthetic nucleic acid sequence
aacataactcaatttgtaaaaaagggt

SEQ ID NO: 282 - DNA, 27 bp, Artificial Sequence
  Synthetic nucleic acid sequence
acccttttttacaaattgagttatgtt

SEQ ID NO: 283 - RNA, 25 nt, Artificial Sequence
  Synthetic nucleic acid sequence
auaacucaauuuguaaaaaaguuuu

SEQ ID NO: 284 - DNA, 23 bp, Artificial Sequence
  Synthetic nucleic acid sequence
agcataactcaatttgtaaaaaa

SEQ ID NO: 285 - DNA, 23 bp, Artificial Sequence
  Synthetic nucleic acid sequence
aacataactcaatctgtaaaaaa

SEQ ID NO: 286 - DNA, 23 bp, Artificial Sequence
  Synthetic nucleic acid sequence
aacataactcaatttgaaaaaaa

SEQ ID NO: 287 - DNA, 23 bp, Artificial Sequence
  Synthetic nucleic acid sequence
aacataactcaatttgttaaaaa

SEQ ID NO: 288 - DNA, 23 bp, Artificial Sequence
  Synthetic nucleic acid sequence
aacataactcaatttgtataaaa

SEQ ID NO: 289 - DNA, 23 bp, Artificial Sequence
  Synthetic nucleic acid sequence
aacataactcaatttgtaataaa

SEQ ID NO: 290 - DNA, 23 bp, Artificial Sequence
  Synthetic nucleic acid sequence
aacataactcaatttgtaaataa

SEQ ID NO: 291 - DNA, 27 bp, Artificial Sequence
  Synthetic nucleic acid sequence
aacataactcaatttgtaaaaaatggc

SEQ ID NO: 292 - DNA, 27 bp, Artificial Sequence
  Synthetic nucleic acid sequence
gccattttttacaaattgagttatgtt

SEQ ID NO: 293 - DNA, 20 bp, Artificial Sequence
  Synthetic nucleic acid sequence
tattgagttaaagtaaaaaa

SEQ ID NO: 294 - DNA, 20 bp, Artificial Sequence
  Synthetic nucleic acid sequence
tattgagttattgtaaaaaa

SEQ ID NO: 295 - DNA, 20 bp, Artificial Sequence
  Synthetic nucleic acid sequence
tattgagtatttgtaaaaaa

SEQ ID NO: 296 - DNA, 20 bp, Artificial Sequence
  Synthetic nucleic acid sequence
tattgacaatttgtaaaaaa

SEQ ID NO: 297 - DNA, 20 bp, Artificial Sequence
  Synthetic nucleic acid sequence
tattctcaatttgtaaaaaa

SEQ ID NO: 298 - DNA, 20 bp, Artificial Sequence
  Synthetic nucleic acid sequence
taaactcaatttgtaaaaaa

SEQ ID NO: 299 - RNA, 62 nt, Artificial Sequence
  Synthetic nucleic acid sequence
aaaaauuaggugcgcuuggcguuuuagagcuagaaauagcaaguuaaaauaaggcuaguccg

SEQ ID NO: 300 - RNA, 54 nt, Artificial Sequence
  Synthetic nucleic acid sequence
aaaaauuaggugcgcuuggcguuuuagagcuagaaauagcaaguuaaaauaagg

SEQ ID NO: 301 - DNA, 50 bp, Artificial Sequence
  Synthetic nucleic acid sequence
tgcgctggttgatttcttcttgcgctttttgggtattggggaattcatta

SEQ ID NO: 302 - DNA, 50 bp, Artificial Sequence
  Synthetic nucleic acid sequence
taatgaattccccaatacccaaaaagcgcaagaagaaatcaaccagcgca

SEQ ID NO: 303 - RNA, 42 nt, Artificial Sequence
  Synthetic nucleic acid sequence
gauuucuucuugcgcuuuuuguuuuagagcuaugcuguuuug

SEQ ID NO: 304 - DNA, 50 bp, Artificial Sequence
  Synthetic nucleic acid sequence
ggttatattaagtgccgaggaaaaattaggtgcgcttggctggcgcatta

SEQ ID NO: 305 - DNA, 50 bp, Artificial Sequence
  Synthetic nucleic acid sequence
taatgcgccagccaagcgcacctaatttttcctcggcacttaatataacc

SEQ ID NO: 306 - RNA, 42 nt, Artificial Sequence
  Synthetic nucleic acid sequence
aaaaauuaggugcgcuuggcguuuuagagcuaugcuguuuug

SEQ ID NO: 307 - DNA, 50 bp, Artificial Sequence
  Synthetic nucleic acid sequence
tacgctggttgatttcttcttgcgcttttttggctttttcgagttcggct

SEQ ID NO: 308 - DNA, 50 bp, Artificial Sequence
  Synthetic nucleic acid sequence
agccgaactcgaaaaagccaaaaaagcgcaagaagaaatcaaccagcgta

SEQ ID NO: 309 - RNA, 42 nt, Artificial Sequence; identical to SEQ ID NO: 303
  Synthetic nucleic acid sequence

SEQ ID NO: 310 - DNA, 14 bp, Artificial Sequence
  Synthetic nucleic acid sequence
taatgcgccagcca

SEQ ID NO: 311 - RNA, 42 nt, Artificial Sequence; identical to SEQ ID NO: 306
  Synthetic nucleic acid sequence

SEQ ID NO: 312 - DNA, 25 bp, Artificial Sequence
  Synthetic nucleic acid sequence
ataactcaatttgtaaaaaagggta

SEQ ID NO: 313 - DNA, 25 bp, Artificial Sequence
  Synthetic nucleic acid sequence
ataactcaatttgtaaaaaagcgta

SEQ ID NO: 314 - DNA, 25 bp, Artificial Sequence
  Synthetic nucleic acid sequence
ataactcaatttgtaaaaaagccta

SEQ ID NO: 315 - DNA, 26 bp, Artificial Sequence
  Synthetic nucleic acid sequence
aaaaattaggtgcgcttggctggcgc

SEQ ID NO: 316 - DNA, 26 bp, Artificial Sequence
  Synthetic nucleic acid sequence
aaaaattaggtgcgcttggctcgcgc

SEQ ID NO: 317 - DNA, 26 bp, Artificial Sequence
  Synthetic nucleic acid sequence
aaaaattaggtgcgcttggctgccgc

SEQ ID NO: 318 - DNA, 26 bp, Artificial Sequence
  Synthetic nucleic acid sequence
aaaaattaggtgcgcttggctggccc

SEQ ID NO: 319 - DNA, 26 bp, Artificial Sequence
  Synthetic nucleic acid sequence
aaaaattaggtgcgcttggctccccc

SEQ ID NO: 320 - DNA, 21 bp, Artificial Sequence
  Synthetic nucleic acid sequence
aaaaattaggtgcgcttggct

SEQ ID NO: 321 - RNA, 62 nt, Artificial Sequence
  Synthetic nucleic acid sequence
gauuucuucuugcgcuuuuuguuuuagagcuagaaauagcaaguuaaaauaaggcuaguccg

SEQ ID NO: 322 - RNA, 54 nt, Artificial Sequence
  Synthetic nucleic acid sequence
gauuucuucuugcgcuuuuuguuuuagagcuagaaauagcaaguuaaaauaagg

SEQ ID NO: 323 - RNA, 62 nt, Artificial Sequence
  Synthetic nucleic acid sequence
auaacucaauuuguaaaaaaguuuuagagcuagaaauagcaaguuaaaauaaggcuaguccg

SEQ ID NO: 324 - RNA, 54 nt, Artificial Sequence
  Synthetic nucleic acid sequence
auaacucaauuuguaaaaaaguuuuagagcuagaaauagcaaguuaaaauaagg

SEQ ID NO: 325 - DNA, 120 bp, Artificial Sequence
  Synthetic nucleic acid sequence
gtcccaattcttgttgaattagatggtgatgttaatgggcacaaattttctgtcagtggagagggtgaaggtgatgcaacatacggaaaacttacccttaaatttatttgcactactgga

SEQ ID NO: 326 - DNA, 120 bp, Artificial Sequence
  Synthetic nucleic acid sequence
tccagtagtgcaaataaatttaagggtaagttttccgtatgttgcatcaccttcaccctctccactgacagaaaatttgtgcccattaacatcaccatctaattcaacaagaattgggac

SEQ ID NO: 327 - DNA, 26 bp, Artificial Sequence
  Synthetic nucleic acid sequence
ccaattcttgttgaattagatggtga

SEQ ID NO: 328 - DNA, 26 bp, Artificial Sequence
  Synthetic nucleic acid sequence
aattagatggtgatgttaatgggcac

SEQ ID NO: 329 - DNA, 26 bp, Artificial Sequence
  Synthetic nucleic acid sequence
aaattttctgtcagtggagagggtga

SEQ ID NO: 330 - DNA, 26 bp, Artificial Sequence
  Synthetic nucleic acid sequence
catctaattcaacaagaattgggaca

SEQ ID NO: 331 - DNA, 26 bp, Artificial Sequence
  Synthetic nucleic acid sequence
cagtagtgcaaataaatttaagggta

SEQ ID NO: 332 - RNA, 68 nt, Artificial Sequence
  Synthetic nucleic acid sequence
ccaauucuuguugaauuagauggugaguuuuagagcuagaaauagcaaguuaaaauaaggcuaguccg

SEQ ID NO: 333 - RNA, 68 nt, Artificial Sequence
  Synthetic nucleic acid sequence
aauuagauggugauguuaaugggcacguuuuagagcuagaaauagcaaguuaaaauaaggcuaguccg

SEQ ID NO: 334 - RNA, 68 nt, Artificial Sequence
  Synthetic nucleic acid sequence
aaauuuucugucaguggagagggugaguuuuagagcuagaaauagcaaguuaaaauaaggcuaguccg

SEQ ID NO: 335 - RNA, 68 nt, Artificial Sequence
  Synthetic nucleic acid sequence
caucuaauucaacaagaauugggacaguuuuagagcuagaaauagcaaguuaaaauaaggcuaguccg

SEQ ID NO: 336 - RNA, 68 nt, Artificial Sequence
  Synthetic nucleic acid sequence
caguagugcaaauaaauuuaaggguaguuuuagagcuagaaauagcaaguuaaaauaaggcuaguccg

SEQ ID NO: 337 - DNA, 50 bp, Artificial Sequence
  Synthetic nucleic acid sequence
ggttatattaagtgccgaggaaaaattaggtgcgcttggctgccgcatta

SEQ ID NO: 338 - DNA, 50 bp, Artificial Sequence
  Synthetic nucleic acid sequence
taatgcggcagccaagcgcacctaatttttcctcggcacttaatataacc

SEQ ID NO: 339 - RNA, 42 nt, Artificial Sequence; identical to SEQ ID NO: 306
  Synthetic nucleic acid sequence

SEQ ID NO: 340 - DNA, 59 bp, Artificial Sequence
  Synthetic nucleic acid sequence
gaaattaatacgactcactatagaaaacagcatagcaagttaaaataaagttaaaataa

SEQ ID NO: 341 - DNA, 25 bp, Artificial Sequence
  Synthetic nucleic acid sequence
aaaaaaagcaccgactcggtgccac

SEQ ID NO: 342 - DNA, 66 bp, Artificial Sequence
  Synthetic nucleic acid sequence
gaaattaatacgactcactatagggatttcttcttgcgctttttgttttagagctatgctgttttg

SEQ ID NO: 343 - DNA, 66 bp, Artificial Sequence
  Synthetic nucleic acid sequence
caaaacagcatagctctaaaacaaaaagcgcaagaagaaatccctatagtgagtcgtattaatttc

SEQ ID NO: 344 - DNA, 66 bp, Artificial Sequence
  Synthetic nucleic acid sequence
gaaattaatacgactcactataggataactcaatttgtaaaaaagttttagagctatgctgttttg

SEQ ID NO: 345 - DNA, 66 bp, Artificial Sequence
  Synthetic nucleic acid sequence
caaaacagcatagctctaaaacttttttacaaattgagttatcctatagtgagtcgtattaatttc

SEQ ID NO: 346 - DNA, 51 bp, Artificial Sequence
  Synthetic nucleic acid sequence
gaaattaatacgactcactatagatgatgagaaccgttgctacaataaggc

SEQ ID NO: 347 - DNA, 24 bp, Artificial Sequence
  Synthetic nucleic acid sequence
aaataaacgatgccccttaaagca

SEQ ID NO: 348 - DNA, 68 bp, Artificial Sequence
  Synthetic nucleic acid sequence
gaaattaatacgactcactatagatgataactcaatttgtaaaaaagttgtagctccctttctcattt

SEQ ID NO: 349 - DNA, 68 bp, Artificial Sequence
  Synthetic nucleic acid sequence
aaatgagaaagggagctacaacttttttacaaattgagttatcatctatagtgagtcgtattaatttc

SEQ ID NO: 350 - DNA, 51 bp, Artificial Sequence
  Synthetic nucleic acid sequence
gaaattaatacgactcactatagatgaaataacatagcaagttaaaataag

SEQ ID NO: 351 - DNA, 31 bp, Artificial Sequence
  Synthetic nucleic acid sequence
aaaaaaagcgccgaaacagcgctacttaatt

SEQ ID NO: 352 - DNA, 68 bp, Artificial Sequence
  Synthetic nucleic acid sequence
gaaattaatacgactcactatagatgataactcaatttgtaaaaaagttttagagctatgttattttg

SEQ ID NO: 353 - DNA, 68 bp, Artificial Sequence
  Synthetic nucleic acid sequence
caaaataacatagctctaaaacttttttacaaattgagttatcatctatagtgagtcgtattaatttc

SEQ ID NO: 354 - DNA, 35 bp, Artificial Sequence
  Synthetic nucleic acid sequence
atgcacctgcaggatgctgttaaataattgtatac

SEQ ID NO: 355 - DNA, 36 bp, Artificial Sequence
  Synthetic nucleic acid sequence
atgcacggatccagctgctctaagtctactaaaacc

SEQ ID NO: 356 - DNA, 39 bp, Artificial Sequence
  Synthetic nucleic acid sequence
atgcagggccggccgtgacagagagaaacttgattcaac

SEQ ID NO: 357 - DNA, 39 bp, Artificial Sequence
  Synthetic nucleic acid sequence
atgcagggccggcccttcgtttaagtaaacatcaaagtg

SEQ ID NO: 358 - DNA, 59 bp, Artificial Sequence
  Synthetic nucleic acid sequence
atgagcgataatagaataaagttatatgagcataactcaatttgtaaaaaagggtattg

SEQ ID NO: 359 - DNA, 59 bp, Artificial Sequence
  Synthetic nucleic acid sequence
caatacccttttttacaaattgagttatgctcatataactttattctattatcgctcat

SEQ ID NO: 360 - DNA, 57 bp, Artificial Sequence
  Synthetic nucleic acid sequence
gcgataatagaataaagttatatgaacataactcaatctgtaaaaaagggtattggg

SEQ ID NO: 361 - DNA, 57 bp, Artificial Sequence
  Synthetic nucleic acid sequence
cccaatacccttttttacagattgagttatgttcatataactttattctattatcgc

SEQ ID NO: 362 - DNA, 40 bp, Artificial Sequence
  Synthetic nucleic acid sequence
gaacataactcaatttgaaaaaaagggtattggggaattc

SEQ ID NO: 363 - DNA, 40 bp, Artificial Sequence
  Synthetic nucleic acid sequence
gaattccccaataccctttttttcaaattgagttatgttc

SEQ ID NO: 364 - DNA, 40 bp, Artificial Sequence
  Synthetic nucleic acid sequence
gaacataactcaatttgttaaaaagggtattggggaattc

SEQ ID NO: 365 - DNA, 40 bp, Artificial Sequence
  Synthetic nucleic acid sequence
gaattccccaataccctttttaacaaattgagttatgttc

SEQ ID NO: 366 - DNA, 43 bp, Artificial Sequence
  Synthetic nucleic acid sequence
gaacataactcaatttgtataaaagggtattggggaattcatt

SEQ ID NO: 367 - DNA, 43 bp, Artificial Sequence
  Synthetic nucleic acid sequence
aatgaattccccaatacccttttatacaaattgagttatgttc

SEQ ID NO: 368 - DNA, 43 bp, Artificial Sequence
  Synthetic nucleic acid sequence
gaacataactcaatttgtaataaagggtattggggaattcatt

SEQ ID NO: 369 - DNA, 43 bp, Artificial Sequence
  Synthetic nucleic acid sequence
aatgaattccccaataccctttattacaaattgagttatgttc

SEQ ID NO: 370 - DNA, 40 bp, Artificial Sequence
  Synthetic nucleic acid sequence
cataactcaatttgtaaataagggtattggggaattcatt

SEQ ID NO: 371 - DNA, 40 bp, Artificial Sequence
  Synthetic nucleic acid sequence
aatgaattccccaatacccttatttacaaattgagttatg

SEQ ID NO: 372 - DNA, 46 bp, Artificial Sequence
  Synthetic nucleic acid sequence
cataactcaatttgtaaaaaagcgtattggggaattcattataaag

SEQ ID NO: 373 - DNA, 46 bp, Artificial Sequence
  Synthetic nucleic acid sequence
ctttataatgaattccccaatacgcttttttacaaattgagttatg

SEQ ID NO: 374 - DNA, 44 bp, Artificial Sequence
  Synthetic nucleic acid sequence
cataactcaatttgtaaaaaagcctattggggaattcattataa

SEQ ID NO: 375 - DNA, 44 bp, Artificial Sequence
  Synthetic nucleic acid sequence
ttataatgaattccccaataggcttttttacaaattgagttatg

SEQ ID NO: 376 - DNA, 38 bp, Artificial Sequence
  Synthetic nucleic acid sequence
atgcagggccggccagtatcagcgtacttggatttggg

SEQ ID NO: 377 - DNA, 37 bp, Artificial Sequence
  Synthetic nucleic acid sequence
atgcagggccggccttgtctcactcactctatttttg

SEQ ID NO: 378 - DNA, 30 bp, Artificial Sequence
  Synthetic nucleic acid sequence
gatttcttgcgcttttttggctttttcgag

SEQ ID NO: 379 - DNA, 30 bp, Artificial Sequence
  Synthetic nucleic acid sequence
gggatggcaatccatgggtcaaggtactag

SEQ ID NO: 380 - DNA, 20 bp, Artificial Sequence
  Synthetic nucleic acid sequence
ggaacgaaaactcacgttaa

SEQ ID NO: 381 - DNA, 25 bp, Artificial Sequence
  Synthetic nucleic acid sequence
tgagagtgtcttttcagatgctgtg

SEQ ID NO: 382 - DNA, 21 bp, Artificial Sequence
  Synthetic nucleic acid sequence
agcggtatctgttccccaaaa

SEQ ID NO: 383 - DNA, 21 bp, Artificial Sequence
  Synthetic nucleic acid sequence
gttaaaaaccacgtaaccaca

SEQ ID NO: 384 - RNA, 42 nt, Artificial Sequence; identical to SEQ ID NO: 303
  Synthetic nucleic acid sequence

SEQ ID NO: 385 - RNA, 42 nt, Artificial Sequence; identical to SEQ ID NO: 280
  Synthetic nucleic acid sequence

SEQ ID NO: 386 - RNA, 42 nt, Artificial Sequence; identical to SEQ ID NO: 306
  Synthetic nucleic acid sequence

SEQ ID NO: 387 - RNA, 36 nt, Artificial Sequence
  Synthetic nucleic acid sequence
auaacucaauuuguaaaaaaguuuuagagcuaugcu

SEQ ID NO: 388 - RNA, 32 nt, Artificial Sequence
  Synthetic nucleic acid sequence
auaacucaauuuguaaaaaaguuuuagagcua

SEQ ID NO: 389 - RNA, 22 nt, Artificial Sequence
  Synthetic nucleic acid sequence
uuguaaaaaaguuuuagagcua

SEQ ID NO: 390 - RNA, 89 nt, Artificial Sequence
  Synthetic nucleic acid sequence
guuggaaccauucaaaacagcauagcaaguuaaaauaaggcuaguccguuaucaacuugaaaaaguggcaccgagucggugcuuuuuuu

SEQ ID NO: 391 - RNA, 74 nt, Artificial Sequence
  Synthetic nucleic acid sequence
aacagcauagcaaguuaaaauaaggcuaguccguuaucaacuugaaaaaguggcaccgagucggugcuuuuuuu

SEQ ID NO: 392 - RNA, 67 nt, Artificial Sequence
  Synthetic nucleic acid sequence
uagcaaguuaaaauaaggcuaguccguuaucaacuugaaaaaguggcaccgagucggugcuuuuuuu

SEQ ID NO: 393 - RNA, 39 nt, Artificial Sequence
  Synthetic nucleic acid sequence
aaacagcauagcaaguuaaaauaaggcuaguccguuauc

SEQ ID NO: 394 - RNA, 30 nt, Artificial Sequence
  Synthetic nucleic acid sequence
aaacagcauagcaaguuaaaauaaggcuag

SEQ ID NO: 395 - RNA, 22 nt, Artificial Sequence
  Synthetic nucleic acid sequence
aaacagcauagcaaguuaaaau

SEQ ID NO: 396 - RNA, 31 nt, Artificial Sequence
  Synthetic nucleic acid sequence
uagcaaguuaaaauaaggcuaguccguuauc

SEQ ID NO: 397 - RNA, 26 nt, Artificial Sequence
  Synthetic nucleic acid sequence
uagcaaguuaaaauaaggcuaguccg

SEQ ID NO: 398 - RNA, 22 nt, Artificial Sequence
  Synthetic nucleic acid sequence
uagcaaguuaaaauaaggcuag

SEQ ID NO: 399 - RNA, 26 nt, Artificial Sequence
  Synthetic nucleic acid sequence
guuggaaccauucaaaacagcauagc

SEQ ID NO: 400 - RNA, 62 nt, Artificial Sequence; identical to SEQ ID NO: 321
  Synthetic nucleic acid sequence

SEQ ID NO: 401 - RNA, 54 nt, Artificial Sequence; identical to SEQ ID NO: 322
  Synthetic nucleic acid sequence

SEQ ID NO: 402 - RNA, 62 nt, Artificial Sequence; identical to SEQ ID NO: 323
  Synthetic nucleic acid sequence

SEQ ID NO: 403 - RNA, 54 nt, Artificial Sequence; identical to SEQ ID NO: 324
  Synthetic nucleic acid sequence

SEQ ID NO: 404 - RNA, 62 nt, Artificial Sequence; identical to SEQ ID NO: 299
  Synthetic nucleic acid sequence

SEQ ID NO: 405 - RNA, 54 nt, Artificial Sequence; identical to SEQ ID NO: 300
  Synthetic nucleic acid sequence

SEQ ID NO: 406 - RNA, 62 nt, Artificial Sequence
  Synthetic nucleic acid sequence
ccaauucuuguugaauuagaguuuuagagcuagaaauagcaaguuaaaauaaggcuaguccg

SEQ ID NO: 407 - RNA, 62 nt, Artificial Sequence
  Synthetic nucleic acid sequence
aauuagauggugauguuaauguuuuagagcuagaaauagcaaguuaaaauaaggcuaguccg

SEQ ID NO: 408 - RNA, 62 nt, Artificial Sequence
  Synthetic nucleic acid sequence
aaauuuucugucaguggagaguuuuagagcuagaaauagcaaguuaaaauaaggcuaguccg

SEQ ID NO: 409 - RNA, 62 nt, Artificial Sequence
  Synthetic nucleic acid sequence
caucuaauucaacaagaauuguuuuagagcuagaaauagcaaguuaaaauaaggcuaguccg

SEQ ID NO: 410 - RNA, 61 nt, Artificial Sequence
  Synthetic nucleic acid sequence
caguagugcaaauaaauuuaguuuuagagcuagaaauagcaaguuaaaauaaggcuagccg

SEQ ID NO: 411 - DNA, 50 bp, Artificial Sequence; identical to SEQ ID NO: 302
  Synthetic nucleic acid sequence

SEQ ID NO: 412 - DNA, 50 bp, Artificial Sequence; identical to SEQ ID NO: 301
  Synthetic nucleic acid sequence

SEQ ID NO: 413 - DNA, 50 bp, Artificial Sequence; identical to SEQ ID NO: 279
  Synthetic nucleic acid sequence

SEQ ID NO: 414 - DNA, 50 bp, Artificial Sequence; identical to SEQ ID NO: 278
  Synthetic nucleic acid sequence

SEQ ID NO: 415 - DNA, 50 bp, Artificial Sequence; identical to SEQ ID NO: 305
  Synthetic nucleic acid sequence

SEQ ID NO: 416 - DNA, 50 bp, Artificial Sequence; identical to SEQ ID NO: 304
  Synthetic nucleic acid sequence

SEQ ID NO: 417 - DNA, 50 bp, Artificial Sequence
  Synthetic nucleic acid sequence
taatgaattccccaataggcttttttacaaattgagttatgttcatataa

SEQ ID NO: 418 - DNA, 50 bp, Artificial Sequence
  Synthetic nucleic acid sequence
ttatatgaacataactcaatttgtaaaaaagcctattggggaattcatta

SEQ ID NO: 419 - DNA, 50 bp, Artificial Sequence
  Synthetic nucleic acid sequence
taatgaattcccgttatggcttttttacaaattgagttatgttcatataa

SEQ ID NO: 420 - DNA, 50 bp, Artificial Sequence
  Synthetic nucleic acid sequence
ttatatgaacataactcaatttgtaaaaaagccataacgggaattcatta

SEQ ID NO: 421 - DNA, 50 bp, Artificial Sequence
  Synthetic nucleic acid sequence
taatgcgcgagccaagcgcacctaatttttcctcggcacttaatataacc

SEQ ID NO: 422 - DNA, 50 bp, Artificial Sequence
  Synthetic nucleic acid sequence
ggttatattaagtgccgaggaaaaattaggtgcgcttggctcgcgcatta

SEQ ID NO: 423 - DNA, 50 bp, Artificial Sequence; identical to SEQ ID NO: 338
  Synthetic nucleic acid sequence

SEQ ID NO: 424 - DNA, 50 bp, Artificial Sequence; identical to SEQ ID NO: 337
  Synthetic nucleic acid sequence

SEQ ID NO: 425 - DNA, 74 bp, Artificial Sequence
  Synthetic nucleic acid sequence
tcagtcctcatctccctcaagcaggccccgctggtgcactgaagagccaccctgtggaaacactacatctgcaa

SEQ ID NO: 426 - DNA, 74 bp, Artificial Sequence
  Synthetic nucleic acid sequence
ttgcagatgtagtgtttccacagggtggctcttcagtgcaccagcggggcctgcttgagggagatgaggactga

SEQ ID NO: 427 - DNA, 20 bp, Artificial Sequence
  Synthetic nucleic acid sequence
tgtggaaacactacatctgc

SEQ ID NO: 428 - RNA, 62 nt, Artificial Sequence
  Synthetic nucleic acid sequence
gcagauguaguguuuccacaguuuuagagcuagaaauagcaaguuaaaauaaggcuaguccg

SEQ ID NO: 429 - RNA, 75 nt, Artificial Sequence
  Synthetic nucleic acid sequence
gcagauguaguguuuccacaguuuuagagcuaugcugaaaagcauagcaaguuaaaauaaggcuaguccguuauc

SEQ ID NO: 430 - RNA, 87 nt, Artificial Sequence
  Synthetic nucleic acid sequence
gcagauguaguguuuccacaguuuuagagcuaugcuguuuuggaaacaaaacagcauagcaaguuaaaauaaggcuaguccguuauc

SEQ ID NO: 431 - RNA, 86 nt, Artificial Sequence
  Synthetic nucleic acid sequence
ggaaccauucaaaacagcauagcaaguuaaaauaaggcuaguccguuaucaacuugaaaaaguggcaccgagucggugcuuuuuuu

SEQ ID NO: 432 - RNA, 67 nt, Artificial Sequence; identical to SEQ ID NO: 392
  Synthetic nucleic acid sequence

SEQ ID NO: 433 - RNA, 88 nt, Streptococcus pyogenes
guuggaaccauucaaaacagcauagcaaguuaaaauaaggcuaguccguuaucaacuugaaaaaguggcaccgagucggugcuuuuuu

SEQ ID NO: 434 - RNA, 93 nt, Listeria innocua
auauuguuaguauucaaaauaacauagcaaguuaaaauaaggcuuuguccguuaucaacuuuuaauuaaguagcgcuguuucggcgcuuuuuu

SEQ ID NO: 435 - RNA, 104 nt, Streptococcus mutans
uguuggaaucauucgaaacaacacagcaaguuaaaauaaggcagugauuuuuaauccaguccguacacaacuugaaaaagugcgcaccgauucggugcuuuuuu

SEQ ID NO: 436 - RNA, 95 nt, Streptococcus thermophilus
uugugguuugaaaccauucgaaacaacacagcgaguuaaaauaaggcuuaguccguacucaacuugaaaagguggcaccgauucgguguuuuuuu

SEQ ID NO: 437 - RNA, 118 nt, Streptococcus thermophilus
uaauaauaguguaagggacgccuuacacaguuacuuaaaucuugcagaagcuacaaagauaaggcuucaugccgaaaucaacacccugucauuuuauggcaggguguuuucguuauuu

SEQ ID NO: 438 - RNA, 112 nt, Neisseria meningitidis
cauauugucgcacugcgaaaugagaaccguugcuacaauaaggccgucugaaaagaugugccgcaacgcucugccccuuaaagcuucugcuuuaaggggcaucguuuauuuc

SEQ ID NO: 439 - RNA, 110 nt, Pasteurella multocida
gcauauuguugcacugcgaaaugagagacguugcuacaauaaggcuucugaaaagaaugaccguaacgcucugccccuugugauucuuaauugcaaggggcaucguuuuu

SEQ ID NO: 440 - RNA, 115 nt, Mycoplasma mobile
uauuauguauuucgaaauacagauguacaguuaagaauacauaagaaugauacaucacuaaaaaaaggcuuuaugccguaacuacuacuuauuuucaaaauaaguaguuuuuuuu

SEQ ID NO: 441 - RNA, 26 nt, Artificial Sequence
  Synthetic nucleic acid sequence
uagcaaguuaaaauaaggcuaguccg

SEQ ID NO: 442 - RNA, 36 nt, Streptococcus pyogenes
uuguuggaaccauucaaaacagcauagcaaguuaaa

SEQ ID NO: 443 - RNA, 36 nt, Streptococcus mutans
guguuggaaucauucgaaacaacacagcaaguuaaa

SEQ ID NO: 444 - RNA, 36 nt, Streptococcus thermophilus
gguuugaaaccauucgaaacaacacagcgaguuaaa

SEQ ID NO: 445 - RNA, 36 nt, Streptococcus thermophilus
cuuacacaguuacuuaaaucuugcagaagcuacaaa

SEQ ID NO: 446 - RNA, 36 nt, Listeria innocua
auauuguuaguauucaaaauaacauagcaaguuaaa

SEQ ID NO: 447 - RNA, 34 nt, Listeria innocua
auuguuaguauucaaaauaacauagcaaguuaaa

SEQ ID NO: 448 - RNA, 36 nt, Treponema denticola
auuuaagauccaucuuaaauuacacaacgaguucaa

SEQ ID NO: 449 - RNA, 36 nt, Neisseria meningitidis
auugucgcacugcgaaaugagaaccguugcuacaau

SEQ ID NO: 450 - RNA, 38 nt, Neisseria meningitidis
auauugucgcacugcgaaaugagaaccguugcuacaau

SEQ ID NO: 451 - RNA, 36 nt, Streptococcus gordonii; identical to SEQ ID NO: 445

SEQ ID NO: 452 - RNA, 36 nt, Bifidobacterium bifidum
augaucaaggucauugaccugacaggcauaaauuga

SEQ ID NO: 453 - RNA, 36 nt, Lactobacillus salivarius
gguuuugaccucauugauuuaacauucugaguugaa

SEQ ID NO: 454 - RNA, 37 nt, Francisella tularensis
guuucaguuguuagauuauuugguauguacuuguguu

SEQ ID NO: 455 - RNA, 37 nt, Francisella tularensis
auuacagagcauuaauuauuugguacauuuauaauuu

SEQ ID NO: 456 - RNA, 37 nt, Legionella pneumophila
auuucaggguaucgaaauuuagaugauuucuaauuua

SEQ ID NO: 457 - RNA, 36 nt, Nitratifractor salsuginis
uguaacaggguaggguuuuuugaggggucuuaaaau

SEQ ID NO: 458 - RNA, 36 nt, Butyrivibrio fibrisolvens
aguuucuaaucacuuaauuuuuucggaccuacuaaa

SEQ ID NO: 459 - RNA, 36 nt, Streptobacillus moniliformis
gauucacauuauucaaguuuacuacagauucuguau

SEQ ID NO: 460 - RNA, 36 nt, Mycoplasma mobile
aguuaagaauacauaagaaugauacaucacuaaaaa

SEQ ID NO: 461 - RNA, 44 nt, Capnocytophaga ochracea
auugugaauugcuuucaaauugugcgacaaaaguagguauaaua

SEQ ID NO: 462 - RNA, 36 nt, Acidovorax ebreus
auugcagcaacggcucucaccccggauaaccacaau

SEQ ID NO: 463 - RNA, 36 nt, Wolinella succinogenes
auagccgcugccuacucagccauuuagcgcagcgac

SEQ ID NO: 464 - RNA, 37 nt, Wolinella succinogenes
uuuguuaaagcuggaugggauuauuauagaguguugc

SEQ ID NO: 465 - RNA, 37 nt, Wolinella succinogenes
uuucaaggcaucgaacggauuugcuauaaaguguugc

SEQ ID NO: 466 - RNA, 36 nt, Prevotella ruminicola
uuuugcacacguaagauuccuacaucuuaucacaau

SEQ ID NO: 467 - RNA, 48 nt, Fibrobacter succinogenes
auugugaauugcuuucagauuaugaaaauaauauaguuaaaauuuuug

SEQ ID NO: 468 - RNA, 36 nt, Campylobacter jejuni
auuuuauuucgauuuuaaucaacccuaaauuucaau

SEQ ID NO: 469 - RNA, 36 nt, Campylobacter jejuni
auuuuagucccuuuuuaaauuucuuaugagauuaua

SEQ ID NO: 470 - RNA, 25 nt, Campylobacter jejuni
aagaaauuuaaaaagggacuaaaau

SEQ ID NO: 471 - RNA, 36 nt, Pasteurella multocida
auuguagcaacgucucucauuucgcagugcaacaau

SEQ ID NO: 472 - RNA, 36 nt, Rhodopseudomonas palustris
gccguggcuuuccuaccgauuucccaccgcaugauu

SEQ ID NO: 473 - RNA, 36 nt, Olsenella uli
ucugaauuaccagucagaacgauacugcgagucaaa

SEQ ID NO: 474 - RNA, 36 nt, Rhodospirillum rubrum
guuccauggccccgucccacacgccaugauagagcg

SEQ ID NO: 475 - RNA, 36 nt, Rhodospirillum rubrum
aaacgggagaaccgucccacacggccaugguagagu

SEQ ID NO: 476 - RNA, 36 nt, Dinoroseobacter shibae
uuaacggcucgaccgcgaauucugaacguaaagaca

SEQ ID NO: 477 - RNA, 36 nt, Verminephrobacter eiseniae
uuagcguccagagcgcauaucccagugagauauccg

SEQ ID NO: 478 - RNA, 75 nt, Streptococcus pyogenes
aaacagcauagcaaguuaaaauaaggcuaguccguuaucaacuugaaaaaguggcaccgagucggugcuuuuuuu

SEQ ID NO: 479 - RNA, 77 nt, Listeria innocua
aaauaacauagcaaguuaaaauaaggcuuuguccguuaucaacuuuuaauuaaguagcgcuguuucggcgcuuuuuu

SEQ ID NO: 480 - RNA, 73 nt, Artificial Sequence
  Synthetic nucleic acid sequence
aacagcauagcaaguuaaaauaaggcuaguccguuaucaacuugaaaaaguggcaccgagucggugcuuuuuu

SEQ ID NO: 481 - RNA, 33 nt, Francisella novicida
uauaaauguaccaaauaauuaaugcucuguaau

SEQ ID NO: 482 - RNA, 74 nt, Campylobacter jejuni
aagaaauuuaaaaagggacuaaaauaaagaguuugcgggacucugcgggguuacaauccccuaaaaccgcuuuu

SEQ ID NO: 483 - RNA, 96 nt, Francisella novicida
aucuaaaauuauaaauguaccaaauaauuaaugcucuguaaucauuuaaaaguauuuugaacggaccucuguuugacacgucugaauaacuaaaaa

SEQ ID NO: 484 - RNA, 109 nt, Streptococcus thermophilus2
uguaagggacgccuuacacaguuacuuaaaucuugcagaagcuacaaagauaaggcuucaugccgaaaucaacacccugucauuuuauggcaggguguuuucguuauuu

SEQ ID NO: 485 - RNA, 110 nt, Mycoplasma mobile
uguauuucgaaauacagauguacaguuaagaauacauaagaaugauacaucacuaaaaaaaggcuuuaugccguaacuacuacuuauuuucaaaauaaguaguuuuuuuu

SEQ ID NO: 486 - RNA, 92 nt, Listeria innocua
auuguuaguauucaaaauaacauagcaaguuaaaauaaggcuuuguccguuaucaacuuuuaauuaaguagcgcuguuucggcgcuuuuuuu

SEQ ID NO: 487 - RNA, 89 nt, Streptococcus pyogenes; identical to SEQ ID NO: 390

SEQ ID NO: 488 - RNA, 107 nt, Streptococcus mutans
guuggaaucauucgaaacaacacagcaaguuaaaauaaggcagugauuuuuaauccaguccguacacaacuugaaaaagugcgcaccgauucggugcuuuuuuauuu

SEQ ID NO: 489 - RNA, 96 nt, Streptococcus thermophilus
uugugguuugaaaccauucgaaacaacacagcgaguuaaaauaaggcuuaguccguacucaacuugaaaagguggcaccgauucgguguuuuuuuu

SEQ ID NO: 490 - RNA, 102 nt, Neisseria meningitidis
acauauugucgcacugcgaaaugagaaccguugcuacaauaaggccgucugaaaagaugugccgcaacgcucugccccuuaaagcuucugcuuuaaggggca

SEQ ID NO: 491 - RNA, 110 nt, Pasteurella multocida; identical to SEQ ID NO: 439

SEQ ID NO: 492 - RNA, 37 nt, Francisella novicida
aacacaaguacauaccaaauaaucuaacaacugaaac

SEQ ID NO: 493 - RNA, 37 nt, Francisella novicida
aaauuauaaauguaccaaauaauuaaugcucuguaau

SEQ ID NO: 494 - RNA, 37 nt, Wolinella succinogenes; identical to SEQ ID NO: 465

SEQ ID NO: 495 - RNA, 37 nt, Wolinella succinogenes; identical to SEQ ID NO: 464

SEQ ID NO: 496 - RNA, 37 nt, Unknown
  gamma proteobacterium
auuucaguguauagaauguugggaugcauucugaaua

SEQ ID NO: 497 - RNA, 37 nt, Unknown
  gamma proteobacterium
auaacaagggaguauuugcuggaauaagcucugaaac

SEQ ID NO: 498 - RNA, 37 nt, Sutterella wadsworthensis
guuuccaagcaauagcucguggcguuaugauuucugu

SEQ ID NO: 499 - RNA, 37 nt, Sutterella wadsworthensis
ggugauuuccuauagcucauagcguuaugaucucuaa

SEQ ID NO: 500 - RNA, 37 nt, Legionella pneumophila; identical to SEQ ID NO: 456

SEQ ID NO: 501 - RNA, 36 nt, Listeria innocua; identical to SEQ ID NO: 446

SEQ ID NO: 502 - RNA, 36 nt, Streptococcus thermophilus; identical to SEQ ID NO: 444

SEQ ID NO: 503 - RNA, 36 nt, Streptococcus mutans; identical to SEQ ID NO: 443

SEQ ID NO: 504 - RNA, 36 nt, Streptococcus pyogenes; identical to SEQ ID NO: 442

SEQ ID NO: 505 - RNA, 36 nt, Fusobacterium nucleatum
auuuuuaauuuaaguaauaaaaaauggagcauauac

SEQ ID NO: 506 - RNA, 36 nt, Filifactor alocis
aguugacuaccauaugagauuacacuacacgguuca

SEQ ID NO: 507 - RNA, 36 nt, Treponema denticola; identical to SEQ ID NO: 448

SEQ ID NO: 508 - RNA, 36 nt, Solobacterium moorei
cuuauaccaguaagauaauuuacauaguaaguucaa

SEQ ID NO: 509 - RNA, 36 nt, Veillonella atypica
guuuuggagguuuacagaauuacacuacgaguucaa

SEQ ID NO: 510 - RNA, 36 nt, Finegoldia magna
guuuaauaccuauaugagauuacaucaugaguucaa

SEQ ID NO: 511 - RNA, 36 nt, Olsenella uli; identical to SEQ ID NO: 473

SEQ ID NO: 512 - RNA, 36 nt, Lactobacillus rhamnosus
caacuugaauugauugaucugacaucuacgaguuga

SEQ ID NO: 513 - RNA, 36 nt, Lactobacillus gasseri
ugauuagauuucauugaucuaacagccaucuaaaac

SEQ ID NO: 514 - RNA, 36 nt, Lactobacillus gasseri
acacuaaacuuuauugaucuaacaaccagauuuaaa

SEQ ID NO: 515 - RNA, 36 nt, Oenococcus kitaharae
ggguucuaccucauugaucugacacacagcauugaa

SEQ ID NO: 516 - RNA, 36 nt, Bifidobacterium bifidum; identical to SEQ ID NO: 452

SEQ ID NO: 517 - RNA, 36 nt, Staphylococcus pseudintermedius
guuuuacuucuuucuaaauaaacauaguuaaguuaa

SEQ ID NO: 518 - RNA, 36 nt, Eubacterium rectale
auuuuauagucacguaaauuuuucagaucuacuaaa

SEQ ID NO: 519 - RNA, 38 nt, Enterococcus faecalis
auuuuacugauaagaaauuauugagaaucuacaaaaau

SEQ ID NO: 520 - RNA, 36 nt, Streptococcus thermophilus; identical to SEQ ID NO: 445

SEQ ID NO: 521 - RNA, 36 nt, Staphylococcus lugdunensis
cuuguacuuauaccuaaaauuacagaaucuacugaa

SEQ ID NO: 522 - RNA, 36 nt, Unknown
  Eubacterium dolichum
aucauaaucuagcaaaaguuuauaugaucuaacaaa

SEQ ID NO: 523 - RNA, 36 nt, Mycoplasma mobile; identical to SEQ ID NO: 460

SEQ ID NO: 524 - RNA, 36 nt, Mycoplasma ovipneumoniae
auuuuacucuaguaagaaauugucgcacaaaaauaa

SEQ ID NO: 525 - RNA, 36 nt, Mycoplasma gallisepticum
auuauugcuuacacaauuauugucgugcuaaaauaa

SEQ ID NO: 526 - RNA, 36 nt, Mycoplasma canis
auuauuguuuacccaaauauuguacauccuaaauca

SEQ ID NO: 527 - RNA, 36 nt, Mycoplasma synoviae
uacuuacuuaacaaaauaauuguacgauuccaaaau

SEQ ID NO: 528 - RNA, 36 nt, Aminomonas paucivorans
gccuucccucccugccgaaggagcagauccucuccu

SEQ ID NO: 529 - RNA, 36 nt, Clostridium perfringens
uuauaguaacuaguuaaacucucgauaugcuauacc

SEQ ID NO: 530 - RNA, 36 nt, Clostridium cellulolyticum
auuauagcaacaauucaggcuccgauaugccauaau

SEQ ID NO: 531 - RNA, 36 nt, Acidovorax ebreus; identical to SEQ ID NO: 462

SEQ ID NO: 532 - RNA, 36 nt, Neisseria meningitidis; identical to SEQ ID NO: 449

SEQ ID NO: 533 - RNA, 36 nt, Pasteurella multocida
auuguugcacugcgaaaugagagacguugcuacaau

SEQ ID NO: 534 - RNA, 36 nt, phylotype Rs-D17
uuuguaacuuaucugagagaggaugguuauuauaau

SEQ ID NO: 535 - RNA, 36 nt, Wolinella succinogenes; identical to SEQ ID NO: 463

SEQ ID NO: 536 - RNA, 36 nt, Campylobacter jejuni
auaauacaaaaaucauuuuuuuaaacaaacauaaac

SEQ ID NO: 537 - RNA, 36 nt, Campylobacter jejuni
uauaaucucauaagaaauuuaaaaagggacuaaaau

SEQ ID NO: 538 - RNA, 36 nt, Helicobacter mustelae
guauuugucaauaaauauacuuuauaauggcaagau

SEQ ID NO: 539 - RNA, 36 nt, Roseburia intestinalis
uuguaauaaccuaauuaucacuugguaugauauaau

SEQ ID NO: 540 - RNA, 36 nt, Lactobacillus coryniformis
uuuuauucuauaguaaguuuucagcuaaaauagauc

SEQ ID NO: 541 - RNA, 36 nt, Rhodopseudomonas palustris; identical to SEQ ID NO: 472

SEQ ID NO: 542 - RNA, 36 nt, Cand. Puniceispirillum marinum
uaaccauaggcuccucaaucaccagaguguuauugc

SEQ ID NO: 543 - RNA, 36 nt, Verminephrobacter eiseniae; identical to SEQ ID NO: 477

SEQ ID NO: 544 - RNA, 36 nt, Ralstonia syzygii
guuaguagcaaagcgcaauucccgaucugcuggaaa

SEQ ID NO: 545 - RNA, 36 nt, Unknown
  Azospirillum sp. B510
uuaacggcuggacccccgauccccaucgaauuucca

SEQ ID NO: 546 - RNA, 36 nt, Dinoroseobacter shibae; identical to SEQ ID NO: 476

SEQ ID NO: 547 - RNA, 36 nt, Rhodospirillum rubrum; identical to SEQ ID NO: 474

SEQ ID NO: 548 - RNA, 36 nt, Rhodospirillum rubrum; identical to SEQ ID NO: 475

SEQ ID NO: 549 - RNA, 36 nt, Unknown
  Sphaerochaeta globus str. Buddy
auuagagauaaucgcugguuuuuguuaagauauaac

SEQ ID NO: 550 - RNA, 36 nt, Prevotella ruminicola; identical to SEQ ID NO: 466

SEQ ID NO: 551 - RNA, 36 nt, Flavobacterium columnare
agauaaaauuauucuaaucuuuaaucuuaucacaau

SEQ ID NO: 552 - RNA, 36 nt, Parvibaculum lavamentivorans
cuugcgaaaagcgaccgccucucgauuugcuacaga

SEQ ID NO: 553 - RNA, 44 nt, Capnocytophaga ochracea; identical to SEQ ID NO: 461

SEQ ID NO: 554 - RNA, 48 nt, Fibrobacter succinogenes; identical to SEQ ID NO: 467

SEQ ID NO: 555 - RNA, 36 nt, Nitratifractor salsuginis; identical to SEQ ID NO: 457

SEQ ID NO: 556 - RNA, 36 nt, Akkermansia muciniphila
cuuauacgggaacuccacgauaaggcauuuuacaug

SEQ ID NO: 557 - RNA, 88 nt, Artificial Sequence
  Synthetic nucleic acid sequence
uuggaaccauucaaaacagcauagcaaguuaaaauaaggcuaguccguuaucaacuugaaaaaguggcaccgagucggugcuuuuuuu

SEQ ID NO: 558 - RNA, 77 nt, Artificial Sequence
  Synthetic nucleic acid sequence
caaaacagcauagcaaguuaaaauaaggcuaguccguuaucaacuugaaaaaguggcaccgagucggugcuuuuuuu

SEQ ID NO: 559 - RNA, 61 nt, Artificial Sequence
  Synthetic nucleic acid sequence
caaaacagcauagcaaguuaaaauaaggcuaguccguuaucaacuugaaaaaguuuuuuuu

SEQ ID NO: 560 - RNA, 44 nt, Artificial Sequence
  Synthetic nucleic acid sequence
caaaacagcauagcaaguuaaaauaaggcuaguccguuuuuuuu

SEQ ID NO: 561 - RNA, 72 nt, Artificial Sequence
  Synthetic nucleic acid sequence
caaaacagcauagcaaguuaaaauaaggcuaguccgguucacugccguauaggcagcuaagaaauuuuuuuu

SEQ ID NO: 562 - RNA, 14 nt, Artificial Sequence
  Synthetic nucleic acid sequence
uagcaaguuaaaau

SEQ ID NO: 563 - RNA, 102 nt, Artificial Sequence
  Synthetic nucleic acid sequence
  misc_feature (1)..(80): n at each of these positions can be present or absent such that this region can contain anywhere from 12 to 80 nucleotides. n is a, c, g, or u
nnnnnnnnnnnnnnnnnnnnnnnnnnnnnnnnnnnnnnnnnnnnnnnnnnnnnnnnnnnnnnnnnnnnnnnnnnnnnnnnguuuuagagcuaugcuguuuug

SEQ ID NO: 564 - RNA, 102 nt, Artificial Sequence
  Synthetic nucleic acid sequence
  misc_feature (1)..(80): n at each of these positions can be present or absent such that this region can contain anywhere from 12 to 80 nucleotides. n is a, c, g, or u
nnnnnnnnnnnnnnnnnnnnnnnnnnnnnnnnnnnnnnnnnnnnnnnnnnnnnnnnnnnnnnnnnnnnnnnnnnnnnnnnguuuuagagcuauguuauuuug

SEQ ID NO: 565 - RNA, 92 nt, Artificial Sequence
  Synthetic nucleic acid sequence
  misc_feature (1)..(80): n at each of these positions can be present or absent such that this region can contain anywhere from 12 to 80 nucleotides. n is a, c, g, or u
nnnnnnnnnnnnnnnnnnnnnnnnnnnnnnnnnnnnnnnnnnnnnnnnnnnnnnnnnnnnnnnnnnnnnnnnnnnnnnnnguuuuagagcua

SEQ ID NO: 566 - RNA, 152 nt, Artificial Sequence
  Synthetic nucleic acid sequence
  misc_feature (37)..(116): n at each of these positions can be present or absent such that this region can contain anywhere from 12 to 80 nucleotides. n is a, c, g, or u
guuuuagagcuaugcuguuuugaauggucccaaaacnnnnnnnnnnnnnnnnnnnnnnnnnnnnnnnnnnnnnnnnnnnnnnnnnnnnnnnnnnnnnnnnnnnnnnnnnnnnnnnnguuuuagagcuaugcuguuuugaauggucccaaaac

SEQ ID NO: 567 - RNA, 188 nt, Artificial Sequence
  Synthetic nucleic acid sequence
  misc_feature (37)..(116): n at each of these positions can be present or absent such that this region can contain anywhere from 12 to 80 nucleotides. n is a, c, g, or u
guuuuagagcuaugcuguuuugaauggucccaaaacnnnnnnnnnnnnnnnnnnnnnnnnnnnnnnnnnnnnnnnnnnnnnnnnnnnnnnnnnnnnnnnnnnnnnnnnnnnnnnnnguuuuagagcuaugcuguuuugaauggucccaaaacguuuuagagcuaugcuguuuugaauggucccaaaac

SEQ ID NO: 568 - RNA, 22 nt, Artificial Sequence
  Synthetic nucleic acid sequence
guuuuagagcuaugcuguuuug

SEQ ID NO: 569 - RNA, 36 nt, Streptococcus pyogenes
guuuuagagcuaugcuguuuugaauggucccaaaac

SEQ ID NO: 570 - RNA, 36 nt, Pasteurella multocida
guuguaguucccucucucauuucgcagugcuacaau

SEQ ID NO: 571 - RNA, 36 nt, Mycoplasma mobile
guuuugguguaguaucauucuuauguauucuuaaac

SEQ ID NO: 572 - RNA, 37 nt, Francisella novicida
guuucaguugcugaauuauuugguaaacuacuguuag

SEQ ID NO: 573 - RNA, 33 nt, Francisella novicida
guuucaguugcugaauuauuugguaaacuacug

SEQ ID NO: 574 - RNA, 36 nt, Streptococcus mutans
guuuuagagcuguguuguuucgaaugguuccaaaac

SEQ ID NO: 575 - RNA, 36 nt, Streptococcus thermophilus; identical to SEQ ID NO: 574

SEQ ID NO: 576 - RNA, 36 nt, Streptococcus thermophilus
guuuuuguacucucaagauuuaaguaacuguacaac

SEQ ID NO: 577 - RNA, 36 nt, Listeria innocua
guuuuagagcuauguuauuuugaaugcuaacaaaac

SEQ ID NO: 578 - RNA, 36 nt, Treponema denticola
guuugagaguuguguaauuuaagauggaucucaaac

SEQ ID NO: 579 - RNA, 36 nt, Neisseria meningitidis
guuguagcucccuuucucauuucgcagugcuacaau

SEQ ID NO: 580 - RNA, 36 nt, Streptococcus gordonii; identical to SEQ ID NO: 576

SEQ ID NO: 581 - RNA, 35 nt, Bifidobacterium bifidum
guuucaaugccugucagaucaaugacuuugaccac

SEQ ID NO: 582 - RNA, 36 nt, Lactobacillus salivarius
guuucagaaguauguuaaaucaauaagguuaagacc

SEQ ID NO: 583 - RNA, 37 nt, Francisella tularensis
cuaacaguaguuuaccaaauaauucagcaacugaaac

SEQ ID NO: 584 - RNA, 37 nt, Francisella tularensis; identical to SEQ ID NO: 583

SEQ ID NO: 585 - RNA, 37 nt, Legionella pneumophila
ccaauaaucccucaucuaaaaauccaaccacugaaac

SEQ ID NO: 586 - RNA, 36 nt, Nitratifractor salsuginis
guuuuaagaccccucaaaaccccacccuguuacaau

SEQ ID NO: 587 - RNA, 36 nt, Butyrivibrio fibrisolvens
guuuuaguacccgggaaaauuaagugauuggaaaac

SEQ ID NO: 588 - RNA, 36 nt, Streptobacillus moniliformis
gauacagauucuugguaaauuugaauaaugugaaug

SEQ ID NO: 589 - RNA, 36 nt, Mycoplasma mobile; identical to SEQ ID NO: 571

SEQ ID NO: 590 - RNA, 44 nt, Capnocytophaga ochracea
uguuaucaaucgcaaaacuacaaaauuugaaagcaauucacaac

SEQ ID NO: 591 - RNA, 36 nt, Acidovorax ebreus
aguguagcuauccggggugagagagggagcuacaac

SEQ ID NO: 592 - RNA, 36 nt, Wolinella succinogenes
auuauagcgaggaauggcugaguaggcggcuauaac

SEQ ID NO: 593 - RNA, 37 nt, Wolinella succinogenes
gcaacacuuuauagcaaauccgcuuagccugugaaac

SEQ ID NO: 594 - RNA, 37 nt, Wolinella succinogenes; identical to SEQ ID NO: 593

SEQ ID NO: 595 - RNA, 36 nt, Prevotella ruminicola
guugugguuugauguaggaaaggaaugauauacaac

SEQ ID NO: 596 - RNA, 48 nt, Fibrobacter succinogenes
guuguuauugcacuaguaaaacuagaaaaucugaaagcaauucacaac

SEQ ID NO: 597 - RNA, 36 nt, Campylobacter jejuni
auuuuaccauaaagaaauuuaaaaagggacuaaaac

SEQ ID NO: 598 - RNA, 36 nt, Campylobacter jejuni
guuuuagucccuuuuuaaauuucuuuaugguaaaau

SEQ ID NO: 599 - RNA, 36 nt, Pasteurella multocida
auuguagcacugcgaaaugagagagggaacuacaac

SEQ ID NO: 600 - RNA, 36 nt, Rhodopseudomonas palustris
agccuaccacggggaaaucgguagggaagccacggc

SEQ ID NO: 601 - RNA, 36 nt, Olsenella uli
guuuuggggcagugucguuuugacugguaaucaaac

SEQ ID NO: 602 - RNA, 36 nt, Rhodospirillum rubrum
acucuaccauggcggugugggacggggccauggaac

SEQ ID NO: 603 - RNA, 36 nt, Rhodospirillum rubrum; identical to SEQ ID NO: 602

SEQ ID NO: 604 - RNA, 36 nt, Dinoroseobacter shibae
aguuuagcuguucagaauucgggguccagccgcaac

SEQ ID NO: 605 - RNA, 36 nt, Verminephrobacter eiseniae
auuguagcucacugggauaugcgcacuggccggaac

SEQ ID NO: 606 - RNA, 37 nt, Francisella novicida; identical to SEQ ID NO: 572

SEQ ID NO: 607 - RNA, 37 nt, Francisella novicida; identical to SEQ ID NO: 572

SEQ ID NO: 608 - RNA, 37 nt, Wolinella succinogenes; identical to SEQ ID NO: 593

SEQ ID NO: 609 - RNA, 37 nt, Wolinella succinogenes; identical to SEQ ID NO: 593

SEQ ID NO: 610 - RNA, 37 nt, Unknown
  gamma proteobacterium
guuucagagcuuaucccaacaaaccaacagcugaaac

SEQ ID NO: 611 - RNA, 37 nt, Unknown; identical to SEQ ID NO: 610
  gamma proteobacterium

SEQ ID NO: 612 - RNA, 37 nt, Sutterella wadsworthensis
gcgaagaucauaacgcuacgagcuauagcacugaaac

SEQ ID NO: 613 - RNA, 37 nt, Sutterella wadsworthensis; identical to SEQ ID NO: 612

SEQ ID NO: 614 - RNA, 37 nt, Legionella pneumophila; identical to SEQ ID NO: 585

SEQ ID NO: 615 - RNA, 36 nt, Listeria innocua; identical to SEQ ID NO: 577

SEQ ID NO: 616 - RNA, 36 nt, Streptococcus thermophilus; identical to SEQ ID NO: 574

SEQ ID NO: 617 - RNA, 36 nt, Streptococcus mutans; identical to SEQ ID NO: 574

SEQ ID NO: 618 - RNA, 36 nt, Streptococcus pyogenes; identical to SEQ ID NO: 569

SEQ ID NO: 619 - RNA, 36 nt, Fusobacterium nucleatum
guuugagaguaauguuauuuuaaauagauucaaaac

SEQ ID NO: 620 - RNA, 36 nt, Filifactor alocis
guuugagaguaguguaauuucauaugguagucaaac

SEQ ID NO: 621 - RNA, 36 nt, Treponema denticola; identical to SEQ ID NO: 578

SEQ ID NO: 622 - RNA, 36 nt, Solobacterium moorei
guuugagaacuauguaaauuaugcugguagcaaaac

SEQ ID NO: 623 - RNA, 36 nt, Veillonella atypica
guuugcgaguaguguaauucuguaaaucucuaaaac

SEQ ID NO: 624 - RNA, 36 nt, Finegoldia magna
guuugagaaugauguaauuucauauagguauuaaac

SEQ ID NO: 625 - RNA, 36 nt, Olsenella uli; identical to SEQ ID NO: 601

SEQ ID NO: 626 - RNA, 36 nt, Lactobacillus rhamnosus
gucucagguagaugucagaucaaucaguucaagagc

SEQ ID NO: 627 - RNA, 36 nt, Lactobacillus gasseri
guuuuagaugguuguuagaucaauaagguuuagauc

SEQ ID NO: 628 - RNA, 36 nt, Lactobacillus gasseri; identical to SEQ ID NO: 627

SEQ ID NO: 629 - RNA, 36 nt, Oenococcus kitaharae
gcuucagaugugugucagaucaaugagguagaaccc

SEQ ID NO: 630 - RNA, 36 nt, Bifidobacterium bifidum
guuucagaugccugucagaucaaugacuuugaccac

SEQ ID NO: 631 - RNA, 36 nt, Staphylococcus pseudintermedius
guuuuagcacuauguuuauuuagaaagagguaaaac

SEQ ID NO: 632 - RNA, 36 nt, Eubacterium rectale
auuuuaguaacugaauaauuuacgugacuguaaaac

SEQ ID NO: 633 - RNA, 36 nt, Enterococcus faecalis
guuuuuguauucucaauaauuucuuaucaguaaaac

SEQ ID NO: 634 - RNA, 36 nt, Streptococcus thermophilus; identical to SEQ ID NO: 576

SEQ ID NO: 635 - RNA, 36 nt, Staphylococcus lugdunensis
guuuuaguacucuguaauuuuagguauaagugauac

SEQ ID NO: 636 - RNA, 36 nt, Unknown
  Eubacterium dolichum
guuuuguuaccauauggauuuuugcuagauuaagac

SEQ ID NO: 637 - RNA, 36 nt, Mycoplasma mobile; identical to SEQ ID NO: 571

SEQ ID NO: 638 - RNA, 36 nt, Mycoplasma ovipneumoniae
guuuuugugcuguacaauuucuuacuagaguaaaac

SEQ ID NO: 639 - RNA, 36 nt, Mycoplasma gallisepticum
guuuuagcacuguacaauacuuguguaagcaauaac

SEQ ID NO: 640 - RNA, 36 nt, Mycoplasma canis
guuuuaguguuguacaauauuuggguaaacaauaac

SEQ ID NO: 641 - RNA, 36 nt, Mycoplasma synoviae
guuuugggguuguacaauuauuuuguuaaguaaaac

SEQ ID NO: 642 - RNA, 36 nt, Aminomonas paucivorans
agcauagcauuucggagugcggcagggagcuaugac

SEQ ID NO: 643 - RNA, 36 nt, Clostridium perfringens
auuauagcauaucgagaauuuacuaggaacuauaac

SEQ ID NO: 644 - RNA, 36 nt, Clostridium cellulolyticum
auuauagcauaucggagccugaauuggagcuauaac

SEQ ID NO: 645 - RNA, 36 nt, Acidovorax ebreus; identical to SEQ ID NO: 591

SEQ ID NO: 646 - RNA, 36 nt, Neisseria meningitidis; identical to SEQ ID NO: 579

SEQ ID NO: 647 - RNA, 36 nt, Pasteurella multocida; identical to SEQ ID NO: 570

SEQ ID NO: 648 - RNA, 36 nt, Unknown
  uncultured Termite group 1 bacterium phylotype Rs-D17
guuauaguuuccuuccucucucagaugugcuauaau

SEQ ID NO: 649 - RNA, 36 nt, Wolinella succinogenes; identical to SEQ ID NO: 592

SEQ ID NO: 650 - RNA, 36 nt, Campylobacter jejuni; identical to SEQ ID NO: 598

SEQ ID NO: 651 - RNA, 36 nt, Campylobacter jejuni; identical to SEQ ID NO: 598

SEQ ID NO: 652 - RNA, 36 nt, Helicobacter mustelae
auuuuagcauaaacauauuuaugaaguggcuaaaac

SEQ ID NO: 653 - RNA, 36 nt, Roseburia intestinalis
auuauaccauaccaagugauaacagggaauuacaac

SEQ ID NO: 654 - RNA, 36 nt, Lactobacillus coryniformis
gaucuauuuuagcugaaaacugaaggaaucaauagc

SEQ ID NO: 655 - RNA, 36 nt, Rhodopseudomonas palustris; identical to SEQ ID NO: 600

SEQ ID NO: 656 - RNA, 36 nt, Cand. Puniceispirillum marinum
aguauagcacucuggugauugagagccuagagcaac

SEQ ID NO: 657 - RNA, 36 nt, Verminephrobacter eiseniae; identical to SEQ ID NO: 605

SEQ ID NO: 658 - RNA, 36 nt, Ralstonia syzygii
agguuagcagaucgggaauugcgcucuggcuacaac

SEQ ID NO: 659 - RNA, 36 nt, Unknown
  Azospirillum sp. B510
aguguagccgauggggaucggggguccagccgcaac

SEQ ID NO: 660 - RNA, 36 nt, Dinoroseobacter shibae; identical to SEQ ID NO: 604

SEQ ID NO: 661 - RNA, 36 nt, Rhodospirillum rubrum; identical to SEQ ID NO: 602

SEQ ID NO: 662 - RNA, 36 nt, Rhodospirillum rubrum; identical to SEQ ID NO: 602

SEQ ID NO: 663 - RNA, 36 nt, Unknown
  Sphaerochaeta globus str. Buddy
ggucaaucuuaacaaaaaucagcggucauccccaac

SEQ ID NO: 664 - RNA, 36 nt, Prevotella ruminicola; identical to SEQ ID NO: 595

SEQ ID NO: 665 - RNA, 36 nt, Flavobacterium columnare
guugugguuugauuaaagauuagaaaacacgauauu

SEQ ID NO: 666 - RNA, 36 nt, Parvibaculum lavamentivorans
agaguagcaaaucgagagacggccgcaauccgcagc

SEQ ID NO: 667 - RNA, 44 nt, Capnocytophaga ochracea; identical to SEQ ID NO: 590

SEQ ID NO: 668 - RNA, 48 nt, Fibrobacter succinogenes; identical to SEQ ID NO: 596

SEQ ID NO: 669 - RNA, 36 nt, Nitratifractor salsuginis; identical to SEQ ID NO: 586

SEQ ID NO: 670 - RNA, 36 nt, Akkermansia muciniphila
guuguacugugccuuauuuuggauucaaggcaaaac

SEQ ID NO: 671 - RNA, 44 nt, Artificial Sequence
  Synthetic nucleic acid sequence
guuuuagagcuagaaauagcaaguuaaaauaaggcuaguccguu

SEQ ID NO: 672 - RNA, 60 nt, Artificial Sequence
  Synthetic nucleic acid sequence
  misc_feature (13)..(17): n is a, c, g, or u
guuuuagagcuannnnnuagcaaguuaaaauaaguuaaaauaaggcuaguccguuaucaa

SEQ ID NO: 673 - RNA, 68 nt, Artificial Sequence
  Synthetic nucleic acid sequence
guuuuagagcuaugcugaaaagcauagcaaguuaaaaauaaguuaaaauaaggcuaguccguuaucaa

SEQ ID NO: 674 - RNA, 69 nt, Artificial Sequence
  Synthetic nucleic acid sequence
guuuuagagcuaugcuguuuuggaaacaaaacagcauagcaaguuaaaauaaggcuaguccguuaucaa

SEQ ID NO: 675 - RNA, 70 nt, Artificial Sequence
  Synthetic nucleic acid sequence
guuuuagagcuaguuuuagagcuagaaauagcaaguuaaaauuagcaaguuaaaauaaggcuaguccguu

SEQ ID NO: 676 - RNA, 70 nt, Artificial Sequence
  Synthetic nucleic acid sequence
guuuuagagcuauagcaaguuaaaaugaaaguuuuagagcuauagcaaguuaaaauaaggcuaguccguu

SEQ ID NO: 677 - RNA, 74 nt, Artificial Sequence
  Synthetic nucleic acid sequence
guuuuagagcuagaaauagcaaguuaaaauguuuuagagcuagaaauagcaaguuaaaauaaggcuaguccguu

SEQ ID NO: 678 - RNA, 119 nt, Artificial Sequence
  Synthetic nucleic acid sequence
guuuuagagcuaugcuguuuuggaaacaaaacagcauagcaaguuaaaauguuuuagagcuaugcuguuuuggaaacaaaacagcauagcaaguuaaaauaaggcuaguccguuaucaa

SEQ ID NO: 679 - RNA, 12 nt, Artificial Sequence
  Synthetic nucleic acid sequence
guuuuagagcua

SEQ ID NO: 680 - RNA, 218 nt, Artificial Sequence
  Synthetic nucleic acid sequence
  misc_feature (1)..(80): n at each of these positions can be present or absent such that this region can contain anywhere from 12 to 80 nucleotides. n is a, c, g, or u
  misc_feature (93)..(192): n at each of these positions can be present or absent such that this region can contain anywhere from 3 to 100 nucleotides. n is a, c, g, or u
nnnnnnnnnnnnnnnnnnnnnnnnnnnnnnnnnnnnnnnnnnnnnnnnnnnnnnnnnnnnnnnnnnnnnnnnnnnnnnnnguuuuagagcuannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnuagcaaguuaaaauaaggcuaguccg

SEQ ID NO: 681 - RNA, 219 nt, Artificial Sequence
  Synthetic nucleic acid sequence
  misc_feature (1)..(80): n at each of these positions can be present or absent such that this region can contain anywhere from 12 to 80 nucleotides. n is a, c, g, or u
  misc_feature (93)..(192): n at each of these positions can be present or absent such that this region can contain anywhere from 3 to 100 nucleotides. n is a, c, g, or u
nnnnnnnnnnnnnnnnnnnnnnnnnnnnnnnnnnnnnnnnnnnnnnnnnnnnnnnnnnnnnnnnnnnnnnnnnnnnnnnnguuuuagagcuannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnuagcaaguuaaaauaaggcuuuguccg

SEQ ID NO: 682 - RNA, 163 nt, Artificial Sequence
  Synthetic nucleic acid sequence
  misc_feature (1)..(80): n at each of these positions can be present or absent such that this region can contain anywhere from 12 to 80 nucleotides. n is a, c, g, or u
nnnnnnnnnnnnnnnnnnnnnnnnnnnnnnnnnnnnnnnnnnnnnnnnnnnnnnnnnnnnnnnnnnnnnnnnnnnnnnnnguuuuagagcuagaaauagcaaguuaaaauaaggcuaguccguuaucaacuugaaaaaguggcaccgagucggugcuuuuuuu

SEQ ID NO: 683 - RNA, 39 nt, Artificial Sequence
  Synthetic nucleic acid sequence
aucaacuugaaaaaguggcaccgagucggugcuuuuuuu

SEQ ID NO: 684 - RNA, 33 nt, Artificial Sequence
  Synthetic nucleic acid sequence
aaaaucaaaggaucuucuugagauccuuuuuuu

SEQ ID NO: 685 - RNA, 34 nt, Artificial Sequence
  Synthetic nucleic acid sequence
cgccgaaaaccccgcuucggcgggguuuugccgc

SEQ ID NO: 686 - RNA, 34 nt, Artificial Sequence
  Synthetic nucleic acid sequence
cgcaaaaaaccccgcuucggcgggguuuuuucgc

SEQ ID NO: 687 - RNA, 39 nt, Artificial Sequence
  Synthetic nucleic acid sequence
aaaaaaaaaccccgccccugacagggcgggguuuuuuuu

SEQ ID NO: 688 - RNA, 40 nt, Artificial Sequence
  Synthetic nucleic acid sequence
cgcaaaaaaccccgccccugacagggcgggguuuuuucgc

SEQ ID NO: 689 - RNA, 41 nt, Artificial Sequence
  Synthetic nucleic acid sequence
ucacacuggcucaccuucgggugggccuuucugcguuuaua

SEQ ID NO: 690 - RNA, 46 nt, Artificial Sequence
  Synthetic nucleic acid sequence
agagaauauaaaaagccagauuauuaauccggcuuuuuuauuauuu

SEQ ID NO: 691 - RNA, 80 nt, Artificial Sequence
  Synthetic nucleic acid sequence
ccaggcaucaaauaaaacgaaaggcucagucgaaagacugggccuuucguuuuaucuguuguuugucggugaacgcucuc

SEQ ID NO: 692 - RNA, 123 nt, Artificial Sequence
  Synthetic nucleic acid sequence
aucaaaauuuacggcuuugaaaaaguaauuucgugaccuucgguauaagguuacuacuagauucaggugcucaucagaugcaccacauucucuauaaaaaaaaaugguaucuuucuuauuuga

SEQ ID NO: 693 - RNA, 129 nt, Artificial Sequence
  Synthetic nucleic acid sequence
ccaggcaucaaauaaaacgaaaggcucagucgaaagacugggccuuucguuuuaucuguuguuugucggugaacgcucucuacuagagucacacuggcucaccuucgggugggccuuucugcguuuaua

SEQ ID NO: 694 - RNA, 129 nt, Artificial Sequence
  Synthetic nucleic acid sequence
gcaugugcucuguauguauauaaaacucuuguuuucuucuuuucucuaaauauucuuuccuuauacauuaggaccuuugcagcauaaauuacuauacuucuauuacuagagcccgccgccaccauggag

SEQ ID NO: 695 - RNA, 139 nt, Artificial Sequence
  Synthetic nucleic acid sequence
auuccgauaacuuguuuauugcagcuuauaaugguuacaaauaaagcaauagcaucacaaauuucacaaauaaagcauuuuuuucacugcauucuaguugugguuuguccaaacucaucaauguaucuuaucaugucug

SEQ ID NO: 696 - RNA, 225 nt, Artificial Sequence
  Synthetic nucleic acid sequence
uaauaagcgaauuucuuaugauuuaugauuuuuauuauuaaauaaguuauaaaaaaaauaaguguauacaaauuuuaaagugacucuuagguuuuaaaacgaaaauucuuauucuugaguaacucuuuccuguaggucagguugcuuucucagguauagcaugaggucgcucuuauugaccacaccucuaccggcaugccgagcaaaugccugcaaaucgcuccc

SEQ ID NO: 697 - RNA, 53 nt, Artificial Sequence
  Synthetic nucleic acid sequence
aacuuucaguuuagcggucuguuuuagagcuagaaauagcaaguuaaaauaag

SEQ ID NO: 698 - DNA, 31 bp, Artificial Sequence
  Synthetic nucleic acid sequence
aaggtacccagaccgctaaactgaaagttac

SEQ ID NO: 699 - DNA, 31 bp, Artificial Sequence
  Synthetic nucleic acid sequence
gtaactttcagtttagcggtctgggtacctt

SEQ ID NO: 700 - DNA, 40 bp, Artificial Sequence
  Synthetic nucleic acid sequence
agtttttaaaagagcttggcggttgttttagtcccttttt

SEQ ID NO: 701 - DNA, 42 bp, Artificial Sequence
  Synthetic nucleic acid sequence
caaagtttcattagttgaatttaactgttttagtcccttttt

SEQ ID NO: 702 - DNA, 42 bp, Artificial Sequence
  Synthetic nucleic acid sequence
aagaatgaggatgatgatattttacagttttagtcccttttt

SEQ ID NO: 703 - DNA, 42 bp, Artificial Sequence
  Synthetic nucleic acid sequence
gtgtgctaaaaaaaatggacttaaatgttttagtcccttttt

SEQ ID NO: 704 - DNA, 74 bp, Artificial Sequence
  Synthetic nucleic acid sequence
aagaaatttaaaaagggactaaaataaagagtttgcgggactctgcggggttacaatcccctaaaaccgctttt

SEQ ID NO: 705 - DNA, 54 bp, Artificial Sequence
  Synthetic nucleic acid sequence
ataactcgaccaatatttgacaaagtttcagttgctgaattatttggtaaacct

SEQ ID NO: 706 - DNA, 58 bp, Artificial Sequence
  Synthetic nucleic acid sequence
ggcaggttttgtatggtcatataggagtgtttcagttgctgaattatttggtaaacct

SEQ ID NO: 707 - DNA, 69 bp, Artificial Sequence
  Synthetic nucleic acid sequence
agctatagggttacctatcttttgagtgttggcaaataagtttcagttgctgaattatttggtaaacct

SEQ ID NO: 708 - DNA, 54 bp, Artificial Sequence
  Synthetic nucleic acid sequence
atgcttttaaactactgatatatacgtttcagttgctgaattatttggtaaact

SEQ ID NO: 709 - DNA, 80 bp, Artificial Sequence
  Synthetic nucleic acid sequence
gtaccaaataattaatgctctgtaatcatttaaaagtattttgaacggacctctgtttgacacgtctgaataactaaaaa

SEQ ID NO: 710 - DNA, 52 bp, Artificial Sequence
  Synthetic nucleic acid sequence
tatccattcccagccggaaattaagttgtagctccctttctcatttcgcagt

SEQ ID NO: 711 - DNA, 53 bp, Artificial Sequence
  Synthetic nucleic acid sequence
gcctttttacaagctcgctttctttgttgtagctccctttctcatttcgcagt

SEQ ID NO: 712 - DNA, 53 bp, Artificial Sequence
  Synthetic nucleic acid sequence
taaaggtttctgttgcgacccgaatgttgtagctccctttctcatttcgcagt

SEQ ID NO: 713 - DNA, 55 bp, Artificial Sequence
  Synthetic nucleic acid sequence
taactttgaccgtgtgcaatccagttagttgtagctccctttctcatttcgcagt

SEQ ID NO: 714 - DNA, 52 bp, Artificial Sequence
  Synthetic nucleic acid sequence
aacccactaaattttgcaaatgcggttgtagctccctttctcatttcgcagt

SEQ ID NO: 715 - DNA, 53 bp, Artificial Sequence
  Synthetic nucleic acid sequence
tttttttgtactgttgtttgaacgagttgtagctccctttctcatttcgcagt

SEQ ID NO: 716 - DNA, 55 bp, Artificial Sequence
  Synthetic nucleic acid sequence
ttcgtttcagatagcaaacgcagtagtgttgtagctccctttctcatttcgcagt

SEQ ID NO: 717 - DNA, 84 bp, Artificial Sequence
  Synthetic nucleic acid sequence
atatgacggtgggcaactggtacaggttgtagctccctttctcatttcgcagtgctacaatgccggatatgacggtgggcaact

SEQ ID NO: 718 - DNA, 52 bp, Artificial Sequence
  Synthetic nucleic acid sequence
cttttgtattgattcaaggtgcttgttgtagctccctttctcatttcgcagt

SEQ ID NO: 719 - DNA, 55 bp, Artificial Sequence
  Synthetic nucleic acid sequence
attcgtcgatgatggaaactcgagcatgttgtagctccctttctcatttcgcagt

SEQ ID NO: 720 - DNA, 55 bp, Artificial Sequence
  Synthetic nucleic acid sequence
tagccagtgctaaaaccgcacccgcttgttgtagctccctttctcatttcgcagt

SEQ ID NO: 721 - DNA, 54 bp, Artificial Sequence
  Synthetic nucleic acid sequence
atagaaatacatacgccgagtaattagttgtagctccctttctcatttcgcagt

SEQ ID NO: 722 - DNA, 54 bp, Artificial Sequence
  Synthetic nucleic acid sequence
tttttgtaattgttctgccttttttagttgtagctccctttctcatttcgcagt

SEQ ID NO: 723 - DNA, 53 bp, Artificial Sequence
  Synthetic nucleic acid sequence
acggcggaaaccattgccacaaaacgttgtagctccctttctcatttcgcagt

SEQ ID NO: 724 - DNA, 54 bp, Artificial Sequence
  Synthetic nucleic acid sequence
aataataacccaatacacgatgttaagttgtagctccctttctcatttcgcagt

SEQ ID NO: 725 - DNA, 171 bp, Artificial Sequence
  Synthetic nucleic acid sequence
ttgtcttatttatatacaaatagattattgacttatcatctcacaacggctagaatcccaaacatattgtcgcactgcgaaatgagaaccgttgctacaataaggccgtctgaaaagatgtgccgcaacgctctgccccttaaagcttctgctttaaggggcatcgtttat

SEQ ID NO: 726 - DNA, 35 bp, Artificial Sequence
  Synthetic nucleic acid sequence
ggtaactttgcctaggatagttttagagctatgtt

SEQ ID NO: 727 - DNA, 22 bp, Artificial Sequence
  Synthetic nucleic acid sequence
cattatgttttagagctatgtt

SEQ ID NO: 728 - DNA, 24 bp, Artificial Sequence
  Synthetic nucleic acid sequence
gagttttagagctatgttattttg

SEQ ID NO: 729 - DNA, 27 bp, Artificial Sequence
  Synthetic nucleic acid sequence
ttatagttttagagctatgttattttg

SEQ ID NO: 730 - DNA, 26 bp, Artificial Sequence
  Synthetic nucleic acid sequence
taaatgttttagagctatgttatttt

SEQ ID NO: 731 - DNA, 23 bp, Artificial Sequence
  Synthetic nucleic acid sequence
tacaagttttagagctatgttat

SEQ ID NO: 732 - DNA, 30 bp, Artificial Sequence
  Synthetic nucleic acid sequence
ttcatgttgttttagagctatgttattttg

SEQ ID NO: 733 - DNA, 28 bp, Artificial Sequence
  Synthetic nucleic acid sequence
gttttagagctatgctatttcgaatact

SEQ ID NO: 734 - DNA, 92 bp, Artificial Sequence
  Synthetic nucleic acid sequence
attgttagtattcaaaataacatagcaagttaaaataaggctttgtccgttatcaacttttaattaagtagcgctgtttcggcgcttttttt

SEQ ID NO: 735 - DNA, 43 bp, Artificial Sequence
  Synthetic nucleic acid sequence
gccattaattaatatggtgagttttagagctgtgttgtttcga

SEQ ID NO: 736 - DNA, 43 bp, Artificial Sequence
  Synthetic nucleic acid sequence
gctagcgcagttagtgctctgttttagagctgtgttgtttcga

SEQ ID NO: 737 - DNA, 43 bp, Artificial Sequence
  Synthetic nucleic acid sequence
tgttgtgtcatcatagttaggttttagagctgtgttgtttcga

SEQ ID NO: 738 - DNA, 43 bp, Artificial Sequence
  Synthetic nucleic acid sequence
caattagacaatagacaaacgttttagagctgtgttgtttcga

SEQ ID NO: 739 - DNA, 44 bp, Artificial Sequence
  Synthetic nucleic acid sequence
ttcggacatgacttgccacagttttagagctgtgttgttatcga

SEQ ID NO: 740 - DNA, 107 bp, Artificial Sequence
  Synthetic nucleic acid sequence
gttggaatcattcgaaacaacacagcaagttaaaataaggcagtgatttttaatccagtccgtacacaacttgaaaaagtgcgcaccgattcggtgcttttttattt

SEQ ID NO: 741 - RNA, 20 nt, Artificial Sequence
  Synthetic nucleic acid sequence
ugguccgcugccguucgcuu

SEQ ID NO: 742 - RNA, 20 nt, Artificial Sequence
  Synthetic nucleic acid sequence
gcagaaaaaaaccauggguu

SEQ ID NO: 743 - RNA, 20 nt, Artificial Sequence
  Synthetic nucleic acid sequence
aaaaaaccgguucagcugcc

SEQ ID NO: 744 - RNA, 20 nt, Artificial Sequence
  Synthetic nucleic acid sequence
aacuuucaguuuagcggucu

SEQ ID NO: 745 - RNA, 20 nt, Artificial Sequence
  Synthetic nucleic acid sequence
aggacaguuucagguagucc

SEQ ID NO: 746 - RNA, 20 nt, Artificial Sequence
  Synthetic nucleic acid sequence
aaccgguuuuuuagccaugu

SEQ ID NO: 747 - RNA, 20 nt, Artificial Sequence
  Synthetic nucleic acid sequence
uugacagcuagcucaguccu

SEQ ID NO: 748 - RNA, 20 nt, Artificial Sequence
  Synthetic nucleic acid sequence
cccggaagagagucaauuca

SEQ ID NO: 749 - RNA, 20 nt, Artificial Sequence
  Synthetic nucleic acid sequence
cccugaauugacucucuucc

SEQ ID NO: 750 - RNA, 20 nt, Artificial Sequence
  Synthetic nucleic acid sequence
gaauucauuaaagaggagaa

SEQ ID NO: 751 - RNA, 20 nt, Artificial Sequence
  Synthetic nucleic acid sequence
gaauggugcaaaaccuuucg

SEQ ID NO: 752 - DNA, 141 bp, Artificial Sequence
  Synthetic nucleic acid sequence
cgacaccatcgaatggtgcaaaacctttcgcggtatggcatgatagcgcccggaagagagtcaattcagggtggtgaatttgacagctagctcagtcctaggtataatagatctgaattcattaaagaggagaaaggtacc

SEQ ID NO: 753 - RNA, 20 nt, Artificial Sequence
  Synthetic nucleic acid sequence
aacuuucaguuuagcggucu

SEQ ID NO: 754 - RNA, 20 nt, Artificial Sequence
  Synthetic nucleic acid sequence
uggaaccguacuggaacugc

SEQ ID NO: 755 - RNA, 20 nt, Artificial Sequence
  Synthetic nucleic acid sequence
gguaguccgggaugucagcc

SEQ ID NO: 756 - RNA, 20 nt, Artificial Sequence
  Synthetic nucleic acid sequence
aggacaguuucagguagucc

SEQ ID NO: 757 - RNA, 20 nt, Artificial Sequence
  Synthetic nucleic acid sequence
gucuugcagggaggaguccu

SEQ ID NO: 758 - RNA, 20 nt, Artificial Sequence
  Synthetic nucleic acid sequence
gcauaaccggaccgucggac

SEQ ID NO: 759 - RNA, 20 nt, Artificial Sequence
  Synthetic nucleic acid sequence
cuuucagagcaccgucuucc

SEQ ID NO: 760 - RNA, 20 nt, Artificial Sequence
  Synthetic nucleic acid sequence
gaugguguagucuucguugu

SEQ ID NO: 761 - RNA, 20 nt, Artificial Sequence
  Synthetic nucleic acid sequence
caucuaauucaacaagaauu

SEQ ID NO: 762 - RNA, 20 nt, Artificial Sequence
  Synthetic nucleic acid sequence
caucuaauucaacaagaauu

SEQ ID NO: 763 - RNA, 20 nt, Artificial Sequence
  Synthetic nucleic acid sequence
aguagugcaaauaaauuuaa

SEQ ID NO: 764 - RNA, 20 nt, Artificial Sequence
  Synthetic nucleic acid sequence
acaaguguuggccacggaac

SEQ ID NO: 765 - RNA, 20 nt, Artificial Sequence
  Synthetic nucleic acid sequence
uuucaugugauccggauaac

SEQ ID NO: 766 - RNA, 20 nt, Artificial Sequence
  Synthetic nucleic acid sequence
cguuccuguacauaaccuuc

SEQ ID NO: 767 - RNA, 20 nt, Artificial Sequence
  Synthetic nucleic acid sequence
uaacucgauacgauuaacaa

SEQ ID NO: 768 - RNA, 20 nt, Artificial Sequence
  Synthetic nucleic acid sequence
auaauggucugcuaguugaa

SEQ ID NO: 769 - RNA, 20 nt, Artificial Sequence
  Synthetic nucleic acid sequence
auguggucacgcuuuucguu

SEQ ID NO: 770 - RNA, 20 nt, Artificial Sequence
  Synthetic nucleic acid sequence
aacuuucaguuuagcggucu

SEQ ID NO: 771 - RNA, 20 nt, Artificial Sequence
  Synthetic nucleic acid sequence
uggaaccguacuggaacugc

SEQ ID NO: 772 - RNA, 20 nt, Artificial Sequence
  Synthetic nucleic acid sequence
gaugguguagucuucguugu

SEQ ID NO: 773 - RNA, 20 nt, Artificial Sequence
  Synthetic nucleic acid sequence
uuccggguacauacguucgg

SEQ ID NO: 774 - RNA, 20 nt, Artificial Sequence
  Synthetic nucleic acid sequence
gguaguccgggaugucagcc

SEQ ID NO: 775 - RNA, 20 nt, Artificial Sequence
  Synthetic nucleic acid sequence
aggacaguuucagguagucc

SEQ ID NO: 776 - RNA, 20 nt, Artificial Sequence
  Synthetic nucleic acid sequence
uugacagcuagcucaguccu

SEQ ID NO: 777 - RNA, 20 nt, Artificial Sequence
  Synthetic nucleic acid sequence
aaccgguuuuuuagccaugu

SEQ ID NO: 778 - RNA, 20 nt, Artificial Sequence
  Synthetic nucleic acid sequence
aaaaaaccgguucagcugcc

SEQ ID NO: 779 - RNA, 20 nt, Artificial Sequence
  Synthetic nucleic acid sequence
uugggaagggcgaucggugc

SEQ ID NO: 780 - RNA, 20 nt, Artificial Sequence
  Synthetic nucleic acid sequence
gcuggccugguucaccacgc

SEQ ID NO: 781 - RNA, 20 nt, Artificial Sequence
  Synthetic nucleic acid sequence
guagccaaaucgggaaaaac

SEQ ID NO: 782 - RNA, 20 nt, Artificial Sequence
  Synthetic nucleic acid sequence
cgguaagccuucgcacauau

SEQ ID NO: 783 - RNA, 20 nt, Artificial Sequence
  Synthetic nucleic acid sequence
acaagaaccauucgagaguc

SEQ ID NO: 784 - RNA, 20 nt, Artificial Sequence
  Synthetic nucleic acid sequence
gucaagcagcaguauaugcu

SEQ ID NO: 785 - RNA, 20 nt, Artificial Sequence
  Synthetic nucleic acid sequence
ugugaguuagcucacucauu

SEQ ID NO: 786 - RNA, 20 nt, Artificial Sequence
  Synthetic nucleic acid sequence
auguuguguggaauugugag

SEQ ID NO: 787 - RNA, 20 nt, Artificial Sequence
  Synthetic nucleic acid sequence
cuuccggcucguauguugug

SEQ ID NO: 788 - RNA, 20 nt, Artificial Sequence
  Synthetic nucleic acid sequence
gggcgaggagcuguucaccg

SEQ ID NO: 789 - RNA, 20 nt, Artificial Sequence
  Synthetic nucleic acid sequence
ggccacaaguucagcguguc

SEQ ID NO: 790 - RNA, 20 nt, Artificial Sequence
  Synthetic nucleic acid sequence
gcccuugcucaccaugguug

SEQ ID NO: 791 - RNA, 20 nt, Artificial Sequence
  Synthetic nucleic acid sequence
gaccaggaugggcaccaccc

SEQ ID NO: 792 - RNA, 20 nt, Artificial Sequence
  Synthetic nucleic acid sequence
gguggugcagaugaacuuca

SEQ ID NO: 793 - RNA, 20 nt, Artificial Sequence
  Synthetic nucleic acid sequence
guggucacgagggugggcca

SEQ ID NO: 794 - RNA, 20 nt, Artificial Sequence
  Synthetic nucleic acid sequence
gcacggggccgucgccgaug

SEQ ID NO: 795 - protein, 240 aa, Acetobacter aceti
MANIAENLVFGIDLGIGSCGWAVLNQKAKDENIVALGSWCFDVPETDKERIPTNQIRRANRLLRRVIRRRRNRMAEIRRLFASKGMLDTADPDALAKISADPWEMRAKGLDYQLTPQEFAVALGHIAKRRGFKSAAKRVSTNAPSEDSKMLAALEKTKEQSAQYRTIGEMFARDPAYADRRRNRDGCFDRTMSREDLFKETQILFESQRRLGNFSATSETEQAFIDIAFRQKPMQDSERL

SEQ ID NO: 796 - protein, 400 aa, Acetobacter aceti
SFERFRLLCRLVNLRVTDGLEDRPLTPEELRLACEDAGKTRKLSVKKVRSLIGLRDDQRFTTIPPDQEQHDIAARTGDALTGTATFRAILGESFWRQLLPHPEQLDRAAWIISFHELTDTIISKLATIGLPSEVMELIRKALEDGKFSKFKGAASLSDKAARKLIPFLQEGLTYDKACQKAGYNHAASKFTHYDSIDTKAKFNSLMDDVRDSITNPVARKAISEGMKQVWAMRNQWGLPGAICIELARDVGNSAEKRREIESGIKKNTAQRERERQEAKEHLNQSDISSETLLRYRLWKEQGGRCCYTDQPITPSQLIASDNSVQVDHILPWSRFGDDSYLNKALCTAKANQEKKNRTPWEWIHNQKGVEAWNHFTAAVESRKETRGLKKRNFLLKSSKE

SEQ ID NO: 797 - protein, 376 aa, Acetobacter aceti
YAARVMAEAVRLLYPSGNRAEKGGVKRVFTRPGALTAALRHAWGVESLKKINGKRLNDDRHHALDAAVVAAVSEKEIQKLTKSFQICEQKGLARPMRDVPMPWEGFRHQLETAYADIRVARPERRRARGKGHDATIRQLREEKDGPVVYERRAISDLKLTDLERIKDPERNSAIISSLRTWIEKGKPADYPPQSPKGDEIRKIRVMSRNKPAVSVRGGTADRGEMTRVDVFTKMGKKGKPEWFLVPIYRHQVIDRIQWPQPPNQAAANGKSEKNWPTMGLEHEFRFSLYPRSYVQIVKRDGEIIEGYFAGLDRTVAAFSLLSSSDPTSIQRGIGAKTLESIRKYNVNRFGDISMVEQETRTWHGDVCISPDQPDSA

SEQ ID NO: 798 - protein, 1054 aa, Actinobacillus suis
MKLTPLNYILGLDLGIASVGWAVVEIDEQENPLGLIDVGVRTFDRAEVPKTGESLALARRLARSARRLVKRRADRIKKAKRLLKAENILLSADEHLPNDVWQLRVKGLDQKLERQEWAAVLLHLLKHRGYLSQRKNESKSENKELGALLSGVETNHQILQSAEYRTPAEIAVKKFHVEDGHIRNQRGAYTHTFSRLDLLAEMELLFQRQTDLGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKQRESAVKKFKEYFPNFVGEPKGKDILKMRLYELQQAKCLYSGKSLELHRLLEKGYVEVDHALPFSRTWDDSFNNKVLVLANENQNKGNLTPYEWLDGKNNSEHWQNFVARVQTSGFSHTKKQRILSHKLDEKGFIERNLNDTRYVARFLCNFIADNMLLTGKGKRKVFASNGQITALLRGRWGLQKVRDDNDRHHALDAVVVACSTVVMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLSDLERMVNREREVTLYESLKARLEQFGNDPAKAFAEPFHKKGGAVVKAVRVEQTQKSGVLVRDGNGVADNASMVRVDVFTKGGKYFLVPIYTWQVAKGILPNKAVTANVDEIDWLEMDESYQFIFTMYPNDLVKVKLKKEEFFGYYGGLDRATGAIVIKEHDLEKSKGKQGIYRIGVKLALSFEKYQVDELGKNIRPCRPTKRQHVR

SEQ ID NO: 799 - protein, 239 aa, Actinobacillus ureae
MEIRIFSENPKLGLENRLPGYPQYNHEFVQPLFVSRMPTRKMTGKGHMETVKSAKRLDEGLSVLKVPLTQLKLSDLERMVNREREDALYQSLKAHLEQFGNDPAKAFAEPFHKKGGTVVKAVRVEQTQKSGVLVRDGNGVADNTSMVRVDVFTKAGKYFLVPIYKWQVAKRILPNKAVTAGVDEIDWLEMDSSYQFIFTMYANDLVKVKLKKRSILGLLRWFRSCNWGYCYQRTRFREI

SEQ ID NO: 800 - protein, 400 aa, Actinobacillus ureae
MKLTPLNYILGLDLGIASVGWAVVEIDEQENPLGLIDVGVRTFDRAEVAKTGESLALARRLARSSRRLVKRRADRIKKAKRLLKAENLLLSADEILPNDVWQLRVKGLDQKLERQEWAAVLLHILKHRGYLSQRKNESKSENKELGALLSGVATNHQLLQTAEYRTPAEITVKKFQAEENGHGHIRNQRGDYSHTFDRKDLLAEMKLLFQRQAELGNPHTSEKLLENLTTLLLWQKPALAGEAILKMLGKCTFEPAEYKAAKNSYSAERFVWLTKLNNLRILENGIERALTDNERFTLLDQPYEKAKLTYAQARTMLALSDEAIFKGVRYQGEDKKAAEKVALIEMKGYQHIRKALEGAGLKAEWNELKNNSELLDDIGTAFSLYFSISNLPTEIAYFTP

SEQ ID NO: 801 - protein, 1113 aa, Actinomyces georgiae
MSASSQNVERIRYKVGIDVGLRSIGFCAVQVDADDRPVKLLNTVVHVHDAGVSPADAKKADTRKLVSGVARRTRRLYRTRKRRLVDLDRQLDGLGWPLVDPARFADPREPWFAREKLVSGRVDDADERKELLSVALRHIAHHRGWRNPYSTVESLQADAPPSEFLQGLNQRVSEKLGTELDPGLTQGQLVAKLLHRFPNAKIRGPEGILRGKLHQSDNAGELRLICRTQGLDCHITEELVRLVFQAKSPKANKEMRKRIGRDQLPGQGAHIRAEKAHPVFQRFRIVAVLANLRIREAHVDRRLTAEEMRTLTDFLLGLAGSEQPTWEELADNLNIERHQLRGTAKASVDGAPALRFPPIDATTDRIYASKLKWLAEWWRQADEERRGYMVDALSNSGGSEDEPYLDDEIAEMLEQASEEDQAKLDSLHLPGGRASYCLDTLRRLTDAMLGGGLDLFEARKAVFHVDDDWAPPTDPIGAPVGNPPVDRVLKHVARWLEAATGRWGAPQTINIEHVREGLGSEKAARELTRMNDRRRRNNQKLVEEMGEKLGMSGRIRRSDRMRYEAIRRQNCECLYCGQPITYQTMEMDHIVPRAGAASTNSRSNLAAVCRRCNHQKGKLPFAVWAESQDSPAEVRLQDAVQRVRHWLRDAGMGQKELQALRVQVIARLKSKRPDEEFDGRSMESIAWMANELRARVEAQYRGSGTTVRVYRGALTAEARKASGFEGRVNLIGGRGKDRFDRRHHAMDALVIALMNQSVAQTLALRLNMRDSQWLTQSEQTWRQFHGAPGEAARKWEAWDRDMRDASDLFNLALDGGRIPITENVRLRVGNGRVHEDGVIRFKPEYEVKGKTIKGGEARLLGDSLPSEQIDRAETPALWTALTRLPEYDRKSGLPENPDRVIRVNGAVVQATDRIRFFGTPASVAVRGGYAKLGESIHHARIYRINGKTPKYAMIRVYTIDLMRLNHEDIFTAVLKPSTISMRCAEKKLKYAIAEGNAEQIGWLVEGDQLELDAAAYAKGVGADLMREYPMATCWRVAGFPDEAKLRLRPVLLAAEGMGEDAPKFMREVLENQGWRPAVNALLSPGSVRVVRRNVLGEPRFKSSGHLPTTVDLV

SEQ ID NO: 802 - protein, 1101 aa, Actinomyces naeslundii
MWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 803 - protein, 1181 aa, Unknown
  Actinomyces sp. oral taxon 180 str. F0310
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 804 - protein, 1120 aa, Unknown
  Actinomyces sp. oral taxon 848 str. F0332
MNAMKQYNAGIDVGINSVGFAAIEVDSKGLPLNILNNMVVLHDSGVDPGTAKTGATRLANSGTARRTRKLIARRRKRLQKLDRYIEVQGWPLVDFSSLPDPYTPWKIRAKLTQDRLEGEEQGRGLSIALRHMARHRGWRNPYEGVESLHSPKEASKQFKDLKDRVTKVSGVIFDEDATPAEVVCDIGLSPKQRLRSAPSAKYKEGATLADEPVGGKSKEGLLGGKLMQSDNANELRKIGIVQGLSNEKVNEIIDQVFASESPKGQAGKRAKKDELPGQEQYVRALRAHLAFQRFRIVAAVANLRILEAEPKHERLLSQSEKDKVIEFLMSADGDDGVTWSDVAEELGIERECLSGTAKRGADGERPSSFPPTNSTNISIVRSKVKPLIEWWRKASDDEQATLVTALSNADELTDDQPSAETVRQFLSSPDEQSQEKIDKISLPKGRAAYSVNSLERLTRRMLKDSVDLFEARKREFGVDNNWTPTPDSIGEPVGNPAVDRVLKIVNRWLLAVTRKWGPPKVVNIEHVRVGFTSAAQTRKYEEENKTNRERNLAILEELRDKFGTSGKIRREDITRFAALRRQNCQCAYCGEAITFFDCEMDHIVPRKGPGSTNTRNNLVAICERCNKSKSNMPFSLWAQNCDIPGVSVEAVIDRVRTWIKDPELNPKQYNNFKKDVIERLRKTVDDDAIDNRSIESVAWMATELADRIGSHFRTAGANTKVRVYRGWLTSEARKASGFEGKINLIGGRGKTRLDRRHHAMDAATIALMRQSVAQTLVERASIRESDRLRRVVSSSWKDYRGADRDKQFSYGSWLNSMNALAELFNRAIDADGIPVTQNLRLRLGNGEAHDATIRSLEKKRVGASWTIGEIDRASTPQLWLALTRQEDFDQNDGLPANASRELRVKNHWFHAEENVTLFPTKSAAIAVRGGYAEIGNTIHHARLYKLPGKKLTYGMIRVFAIDLLCAWHTDLFSSPLLPESISLRTAETKVRRAVEDGAAMYIGWLVDGDEIVLDPETKAFKSNKIGEYLCEFPGTKRWKVDGFPDKEKLRLRPLQLAGEGLPEDVSAGTEEILGPKGNGWRVAINALFKSSQLVVVRRTALGMVRKLSRRHLPLTTRLRG

SEQ ID NO: 805 - protein, 1095 aa, Unknown
  Actinomyces sp. oral taxon 175 str. F0384
MPAHHLRVGIDVGTHSVGLATLRVDDQGTPIELLSALSHIHDSGIGKEGQKDHDTRKKLSGVARRTRHLLRNRRERLQQLDKVLVDLGFPIPKPEEYPDLSERTDPYRVWRVRARLVEETLPEELRGPAISMAVRHIARHRGWRNPYSKVESLLSPAEESSFMKALRKRIMTKTGEVLDDDITPGQAMAQVALTHKIYMRGPEGILGKLHQSDNANEIRKICARQGISSDVCKQLLRAVFKAESPRGSAVSRVAPDPLPGQGSFRRAPKCDPEFQRFRIISIVANLRISETKGENRPLTVDERRQVVAFLMEDSQADLTWVDVAEKLRVSRQALRGTAMLTADGERSAAQPPIDVTDQIMRKTKISALKTWWDKADAERRGAMVRYLYEGLEDSECAEVIAKLPEKDHAKLDSLHLPAGRAAYSRESLTALSDHMLETTNDLHEARKRLFGVDDSWAPPAEPVGAPVGNPSVDRTLKIVARYLSAVESIWGTPEVIHVEHVRDGFTSERTAEERDKANRSRHNDNQKAIEKIQHDYGKEGYISRGDIVRFHALKLQGSACLYCGTTIGYHTCQLDHIVPQAGPGSNNRRGNLVAVCERCNHSKSNTPFAVWAQKCGIPHVGVKEAISRVNGWVEHNHSTSSGDLTRLKKEVIARLRRTQKDPEIDERSMESVAWMANELHHRIAAAYPETTVMVYRGSITAAARKAASIESRINLIGEKGRKDRLDRRHHAVDASVVALMEPSVAKTLAERSSLRGEQRLTGQEQTWKQYTGLTVGARERFEAWRGHMHRLTELFNESLAADEVYVTQNIRLRLSDGSAHTVKASKLVSHRLGDGLTVQQIDRACTPALWCALTREIDFDEKNGLPAREDRVIRVHGQEISSADCIQVFSKRKKTKSDRDEAPFGAIAVRGGFVEIGSSIHHARIYRIEGEKPAYAMLRVFTHDLLSQRHGDLFSAVIPPQSISMRCAATELRQAISEGRATYLGWIVSGDELHIPVETFTTHKIGSFLKDYPNTTRWRICGYDSETMLILKPRILSAEGLNNSSDIAEYVIKNKGWRVAINKLAKVHPTVVRRDALGRPRHSSRSNLPVTWSIE

SEQ ID NO: 806 - protein, 1144 aa, Unknown
  Actinomyces sp. ICM47
MSMIDSSENVPGIRYRVGIDVGLKSIGFCAVEVDRNDQPVRMLNSMVFIHDAGVDPNENKAAKSRKLTAGVARRTRRLYRTRHQRLVNLDRVLSKEFGWPLPDLTSFKDPREPWHVRAGLLEGYIADDEKRKEALSIALRHIARHRGWRNPYAKVETLLQPSEPSDFLKGLNDRISEELGRAFPADATPGQLVDTYLAHPDYVGRAGTPKLRGPQGILAGKLHQSDNAQEIRGICDVQRIEPAERDRLIRVVFEAKSPKGSAKERGLVGYDELPGQGRHVRAEKAHPAFQLFRMVSVLANLRIREGREERPLTPDELEDLVDFINQVSLKQEVTWQDLADKLRIERADLRGTAKASFDGSPVLRNPPTDVTTEKIMACKVKWLKEWWKEADDEQRGYMVDAFSNSGGSEDGTDVNDEVAELLEQATEDDQLEFEKISLPQGRAAYSLDSLRRLTDRMLRDGVDLHTARRLEFNVGDDWKPAVEPIGAPTGNPAVDRVLKQVSRWLHAATERWGEPTVINIEHARDGLGSERVARELMRENEKRRKANASAVAEMAAKLKLSGKVHRSDQIRYFALQRQNCQCLYCGAPITYTTAEMDHIVPRADGSSTNDRSNLAAVCRTCNHMKGKIPFAVWASSDKANQGVSLTGALERVNMWQRDSGMSPRQLKQLQREVCARLKSKKPDQEFDGRSMESVAWMAVELRTRIEGFYRSRDEESVPSVGVYRGQLTAEARRASGFESRVNLIGGRGKTRFDRRHHAMDALVIALMNPSVSRTLALRLNMRDAQRLTGVEETWKHFYGKPGEASKRFESWRESMLRGVELFNIALSDNAIPFVENIRLRVGSSVIHDATVHSFCPPKTPDGKQIITKGYGEQHSLGSAMPVELIDRAETPALWTALTRCPDFDPKKGLPENPQRTISVNGTRVGPTELVNFFEFSKSGPKACLKVRGGYVDLSGAIHHARIYRIAGKKTAYAMIRVFQVDLLRLKDHDVFTTPLKPSTISMRTAEPKIREALANGTATQIGWLVEGDELVIDTSKYSGGFIGEVLARYPEATSWRVAGFMTPAKLRIKPILLSKEGFVDETQAALLGVEVTSEAIQKTVDRPGWLPAVNVLFGAGGVRVIRRNCLGEERYHSSASLPVSMTLE

SEQ ID NO: 807 - protein, 1103 aa, Unknown
  Actinomyces sp. oral taxon 181 str. F0379
MTKINDDLRYRVGIDVGLKSIGFCAVEVDENDQPLRLLNSMVFVHDAGVDPNENKAAKSRKLTAGVARRTQRGTAQNRRRLAELDRALSEELNWPLPNLEDFEDSYEPWHTRAELVEHYIKDDAERAEALAIAIRHIARHRGWRNPYLSVDSLLTPQEPSKFLRGLNERVTQALGREFPADATPGQLICAYIDSPKYAETQGIRGDSGILSGKLHQFDNVGEIRKICEVQRLDHDVFKLLVRKVFFAKSPRGSAAGLVGHDQIPGQGKYIRAEKAHPDFQLFRIVAVLTNLRIREGKAERCLTPDELRGLVDYILEVQLKQQVTWADLADNLGIERTDLRGTARASFDGSPALRFPPTDVTAEKIMASKVKWLKDWWDKADSERRGFMVDALSNSGGSTGDNDIDDEVAALLEAATEDEQAELEKIQLPQGRAAYSLDSLRRLTKRMLEEGVDLHTARKEEFNVDDDWRPEPEPIEAPVGNPAVDRVLKQVARWLNMATDRWGVPDVINIEHTRDGLGSEKVARELLRESQKRQDLNQKDMDKMIRELGISGKARRSSLIKYQAIQRQNSMCLYCGTEIGFETAEMDHIVPRALSGSTNDRSNLAAVCRACNHQKGAVPFAVWATSGEAHAGVSLEDAIKRVRLWQKGPGMSPKQHKAFQNEVISRLKSRKPDEEFDGRSMESVAWMAVELRTRIDGYYRKVNSDSVPKVGIYRGQLTAEARKASGFENRVNLIGGKGKTRFDRRHHAMDALVIAMMNQSVSQTLALRVNMRESQRITGQEETWKNFYGKPGQASERFEKWREGMLRAVELFNIELAKNAIPFHENVRLRVGSSKVHDDTVRKFIHAKLGEALSVAMIDCAETPALWTALTRLPDFDPKDGLPEDLSREIYIHSRKITADEQLNFFNSPSACLKVRGGYVEIGSSIHHARVYRIDGKKTTYSMVRVFATDLVKMTHEDVFTTPLKPSTISMRTADPKIRKALADGTATQIGWLVEGDELQLETDKYSGGLIGEVLAEYPQLTSWRVAGFYGVTQLRLRPYMLAAEGIPSDASESLRKVIEGKGWLPAINALLSSGCVKVVRRNCLGEPRFNAKSSLPVSQLLR

SEQ ID NO: 808 - protein, 1114 aa, Actinomyces turicensis
MQFHFYMVYVTMKGMNDKDASQQLRYRVGIDVGTHSIGFCAVEVDESGMPIQLLNSMVHKHDSGIDPGGNDTATTRLAEAGVARRTRRLIRRRKKRLQELDAFIEECGWPLVDLATITDARSPWRIRAHLATEHIDDEAEQGKLLSIALRHMARHRGWRSPYARISSLHIQADPSEQLKALAQRVSEKTGISLTADQTPAQLISVYLDVFETGKLRGPEGILGGKLMQSDNANELRRIATVQGLDNDLLKKIIGFVFAAESPKGSAAKRVGKDVLPGAHGLRAEKAHPAFQQFRIVSIVQNLRIKEGTGLRALTSEETEIVVDFLNQAGLTEAPTWEEVADNLEIPRSHLKGTATEGFDGIAPSTRPPFDVTSQKILNGKLKKLSAWWKDADYDHRCAMVNALSNVGSDDEGSLADDDVREFLSDFTDEELEALDKVELPGGRAAYSVDSLEKLTNTMLSEGCDLHSARKIAFGVDDSWTPPAEPIGQPVGNPAVDRVLKQVARWISAATNQWGTPESVNIEHVRDALGSEKASREYQRSLQTRRIRNEKLFAEMRERLDIGGKPRRSELTRYLALQRQNCQCLYCGMPITYTDAEMDHIVPRKGAASTNTRENFAAVCRACNHQKSNLPFAVWAEKTERPGVSVKEAYKRVSDMRIEPGMNGRQMNEFRKAIRLRLTTKHADAEIDGRSLESVAWMANELRHRIEGFYRSAENDVTVRVFRGAVTAEGRRASGFESRVNLIGGKGKTRLDRRHHAMDALTIALMEPGIAQTIALRMNMRESQRVLGEQETWKSFTGGSDTARKRWEHWCEEMLRASELFNVFLAEDRIPICQNKRLRLGSSAVHKAIVQPFEASDKRIVSDAMPVELIDRASTPALWTALTRDPDFDPKEGLPANPSRTIRLHDKRLGPNETVEFFPTAAACLAIRGGYCEIGAGIHHARIFRISGKKTTYAMLRVYQCDLVRFQKENLLTVELPANTISVRTAVPKLREALAHGTAEQIGWLVVGDELKIDLSGFTTGQIETFNETYPQATRWEVTGFPTKTQLRLKPLLIASEGLADDVPDDIVKIVKGPGWWPAIDKLLKIGNVVLYRRDTHGKPRVVSHRSLPLSSKLQ

SEQ ID NO: 809 - protein, 1113 aa, Unknown
  Alcanivorax sp. W11-5
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 810 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 811 - protein, 1552 aa, Unknown
  Anaerophaga sp. HS1
MFSQRNNPYCELLQNVKQLYKEKFGKTNQVDNSIIYGFMKRILGLDLGTNSIGWALVENDENDRKGKIIGMGSRIIPMDMSELDNFNKGASISKTAERTRLRMTRRLRERHLLRRARLHRILNIMGFLPEHYRNSIDFIDKKGCFFEGQEPKIAYKPDKNSEQFCFLFTSSFHEMLEDFRKFQPELIQNRKKVPYDWTIYYLRKKALTQKISKEELAWIILNFNTKRGYYHLRGEDEDNQDNKKIKEFRALKVVNVTEREGANSSGKKWYDMELENGWVYSRQSNLPPNLEGKTIELIVSYTLDNNGNIKKDKNGKEKYSLSMPGEEDWNLVKIKTENDLKTSKKSVGEYIYDHLLKNPDQKIRGKLISTIERKFYKEELSRILKTQMNFYEELKNRELYQKCVEELYPNNKSHQQTLLQKDFIHLIVEDIIFYQRPLKSKRAFVNNCPLEYRVYVDKKSGELIKSGVKCIPKSHPLFQEFRLWQYVRNLRIYERERMVNGRLMVNVDVTNELLPDEEHIVRLFDLLNDRKSFKQDDVLRFVGIKSPKDRKRYSWNYPEDKELPGNETRHLILAWLKKVDGVPEDWLDPEKLKALWHLLYSVTDREEIIKGLHSFAKKYELPDTFVEHFKKIPRLEREYGSFSEKAIKKLLPLMRMGKYWKAEEIPADLLEKAQKIIDAEADDRISDEVREKLLHLKDISQLKGLPLWQASYLVYGRHSETGEVVKWRTSEDLEKYILQFKQHSLRNPVVEQVILEALRVVKDIWEHYGEGKEGFFNEIHVEIGRELKNPADKRKKITSQIQENENTNLRIKALLEELFNDPSVKNVRPYSPAQQEILRIYEDGVLNGQKEIPDDILKISKMARPSKSQLVKYKLWLEQKYRSPYTGEIIPLSQLFTSAYEIEHIIPQARYFDDSFSNKVICEAEVNREKGHQLAFEFITKRGGDEIELNFGKKVTILNVEEYQKFVKDHYGRSLRSLSKMRKLLMEDIPDDFIDRQLNDSRYISKVVRNLLSNIVRAEDENSLVSKHLITCTGGVTTRLKHEWGLNDVWNELITPRFVRLNKMGKEKFGEWINKKGKQVFQIQMPLELQKGFNKKRIDHRHHALDALVVACASRSHVNYLNNDSARANASETRYDLRNKLCYKDKTDSNGNYRWKFYKPWESFTEEAKNRLAGTVVSFKSNRRIMTRSSNRYFKWVDTSEGKKKKLVRQIKGDNQAIRKPLHKDTVLGKVSLRKEKKVSLSKAIDLWESIVDKPLKKRIQSLREQGYDKKLLLKYFKDRNNQFNGQDISRVNIYFFDNNLAARRVTLDASFNSEKRIDGITDSGIKKILYAHLQNEKYHGKKDEKGNEISPYELAFSPEGLEEMNANIKKLNGGKPHCPIYKVRLAETIGEKFKLGEKGNKNKKYVEAAKGTNLFFAVYVDEKGVRSFETIPFSVALERRKQKLAVVPEENENKEKLLFYLSPNDLVYVPDEDEKLIDYRQLSINPTRIYKMVSSSGTQCFFIPHFVASPIVQTMELGPNNKSERAWDGQMIKNVCYKLSVDRLGNVKIEK

SEQ ID NO: 812 - protein, 1515 aa, Anaerophaga thermohalophila
MKRILGLDLGTNSIGWALVESDEEQKSGKIQGIGSRIIPMDQNELDNFNKGNTVSQTAERTRLRMVRRLRERHLLRRERLHRVLKEIGFLPEHYLEQIDFTEKPGGFLPGKEPKIAYKPDNFKDKYDFLFQDSYHEMLSDFQDKNPEFIQKRKKVPQDWTIYYLRKKALTAKITKEELAWIILNFNQKRGYYQLRGEDEDVAKNTKKEEFHALKVVKVKEREDSEGASGKWYDIELENGWVYPRQSNIRPDWEGKILELIVTYNLDKDGNIKTDKEGNEKRSFRMPNKDDWTLRKKRTENEIEKSGKTVGEYIYDNLLDAPDLKIRGKLVSTIERKYYRSELEQILTAQKKYHPELSNSELFNKCISNLYPNNDIHRKALLSKDFVHLIINDIIFYQRPLKSKRSTVSNCPLEYRVYVDKVTGEKKKVPLKCIPKSHPLYQEFRLWQYVKNLRLFEKERFENGRLLTNVDVTEQFLPDEDKYVELFEFLNGRKTFKQDDILKFAGIKSAKDRVKYYWNYPQEKEYPGNETRYLIESRLKKIENVPDEWLNYEKIEELWHLLYSVTDKVEIEKGLQSFAAKYQLPDLFVEVFKGFPRMEREYGAFSKKAIKKLLPLMRMGKYWKLENINPDLIEKVQKIIDGEADDNINDGIRERFSEINEMSDLRGMPLWKASYLVYGRHSEAAEVIRWRTSADLDQYIKDFKQHALRNPIVEQVVLEALRVVKDVWNYFGEGREKFFDEIHVEIGRDLKNPADKRQKIANQIQENENTNLRIKALLVELFNDPEVQNVRPYSPVQQQLLKIYEDGVLNAERDIPDDIQKISRMANPTRNQLIRYKLWLEQKYRSPYTGEIIPLNKLFTSEYEVEHIIPRARYFDDSFSNKIISEAEVNRKKDRMLAFEFIKKLGGSTIDLNYGKKVSVLTVEEYQQFVKDHYGINPHSRLKMQKLLMDEIPESFIERQLNDSRYISKMVRNLLSNIVREENENSPVAKQLITCSGSITNTLKQEWGLNDVWNTIITPRFERLNKMGEQKYGEWVNKEGKPVFQIQMPLELQKGFNKKRIDHRHHALDALIVASATRSHVNYLSNEAAKTNAKDTRFDLRNRLCYKEKRGQNRNFTWRFYKPWNTFTEDAKNALNDIVVSFKSNHRVINKSTNRYFKWENLPGGMKKKRLVRQEKGDNWAIRQSLHKDTVLGKVSLRKVKPVSLSVALDSWNNIVDKALKKKIRSLKDQGYDKKLMLKYFKDRRNEYNGENISRVNVYYFDEEMAARRVDLDTSFNSEKRIEGITDSGIKKIIYAHLKNEKYHGQKDDKGKDISPYELAFSPEGIAEMNANIKQLNGGKPHCPIYKVRLAEPVGEKFQLGETGNKTEKLVEVAKGTNLFFGVYANDEGVRSFATVPFYLAVEREKQGLPAVPQENENGDQLLFWLSPNDLVYVPSEEDAHFANPKQIELDNSRIYKMVSSTGTQCFFIPHFVATPIVQTIELGPNNKSERAWDGQMIKKVCYKLSVDRLGNVEIE

SEQ ID NO: 813 - protein, 333 aa, Bacillus cereus
MMNPNNFTKEDFWRTIILYGLNQATYKIALGQSLIRFSEQQRNVVSMNELAEDFFDMYLERLKNGKPQLATPNRQTAMERIINSYNIGRLTRSQAIEKVEREAFNDVIDRFHTVDSLQVPMKFYEKTDKGIVIFDNVFEIFSDNNNFELRNELDARWDLLESAFEIKRTDSQLVNDIRKLYLANGYERTDITKNRSVLNGYQSNVCFYCGELMSDDDVHVDHVIPRQLINHDDIWNLVLSHGFCNQQKSDNLPDVNYIEKLIERNEYFIKSNHPISNKLKERLGNTPRRRRTTIDRIYEHAKLVLAPWKGIYGYNPATDPFYKTFIRNIVLSK

SEQ ID NO: 814 - protein, 1068 aa, Bacillus cereus
MRYVLGLDIGIASCGWAVINQEKERIEDLGVRIFDKAENPKDGKSLAAPRRDARSTRRTLRRKKHRMQRIKILLVKQGLLFKTELNHLYESATEFDVWNLRLDALERKLHPKEFARVLIHLAKRRGFKSNRKETTLSENGQILESISENQQIMEQQNYRTVGEMILKDKKFENHKRNKDGTYIGTVTRQQLQDEIQMIFHTQRLYKNDYATEEFESSYLEIWASQRPYASKDQIEKMIGYCTLEPKEKRTPKASWSFQYFVALQTINNLRLISKDKIEELSFEEKKQIMNLALEKPIVKYIDIRKLLSIPNDFQFNSLSYSADTVDTTLENKRCIELKEYHSINKVYKQVYGKNTPNLLPIDYDTIAYGLTIFKDDKDILEYLQNKYVNAKGKPIKNLAKKTYDDTFIQALLNLNFTKMGHLSFKALKNIIPFLEEGLSYDKACEKAGYNFKGTSYTERTKYLPVIPQNTNPVVHRALSQTRKVINAIIKKYGSPNAIHIETARELSKTFQERKEIDSRYQDNSKKNEHAIHKLKELGNINPSGINIVKFKLWSEQDGRCMYSGKYIEPHRLFEEGYTEVDHILPYSRSLDDSYNNKILTLGTENQRKGNKTPYEYMGNTSIWDEFETRVQSNKKINFKKQQKLLLQNFSYAREQEFIERNLNDTRYATIYLTSLIQQHLIFSESSSKKKVRTVSGIITSHLRSRWGFNKDRKEGHIHHALDAVIVAVTSNHMIQRVTKYYKLKELNKNLQAKQLPFPEPWEGFRLELEARISPNTQQYLKGIHFKNYADVNLSDIKPIFVSRMPKRSITGELHQETIRKFLGYNEKGKVLTAIKTKLEDIPFDANGDFPMYGKETDLYTYNAIKERYLSHEKDKRKSFQEPLYKPTKSGEIGPLIKSIKIMDTRTIVNPVNQGKGVVYNSKIARTDVFKKEDKYYLIPIYTIDLLKNILPHKAITAGKGYEDWTTIDSSFTFLFSLFPNDLIQIVPSKNKTIKARTTVSKKEILLPSLTGYFKGVHSGTAGITVETHDGSVIANVGSKQLLLFEKYQVDVLGHYTKIKEEKRMGMAI

SEQ ID NO: 815 - protein, 1078 aa, Bacillus cereus
MRYVLGLDIGIASCGWAVINQEKERIEDLGVRIFDKAENPKDGKSLAAPRRDARSTRRTLRRKKHRMQRIKVLLVKHGLLSKTELDHLYESATEVDVWNLRLDALERKLYPKEFARILIHLAKRRGFKSNRKETTLSENGQILESISENQQIMEKQNYRTVGEMILKDKKFENHKRNKNGTYVGTVTRQQLQDEIQMIFHAQRLYKNDYATEEFESSYLEIWASQRPYASKDQIEKMIGYCTLEPKEKRAPKASWSFQYFVALQTINNLRLISKDRIEELSFEEKKQIMNLALEKSIVKYIDIRKLLSVPNEFQFNSLSYSADTVDTAVESRKCIELKEYHSINKVYKQIYGENALNLLPKYYDTIAYGLTIFKDDKDILEYLQNKYVNAKGKPISNFANKTYDDTFIQALLNLNFTKMGHLSFKALKNIIPFLEEGLSYDKACEKAGYNFKGTSYTEQTKYLPVIPQNTNPVVHRALSQTRKVINAIIKKYGSPNAIHIETARELSKTFQERKEIDSMYQDNSKKNEHAIHKLKELGNINPSGINIVKFKLWNEQDGRCMYSGKYIEPHRLFEEGYTEVDHILPYSRSLDDSYNNKTLTLGTENQRKGNKIPYEYMGNTSIWNDFETRVQSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGLRFKNYADVNLSEIKSIFVSRMPKHSITGELHQETIRKFIGYNEKGKVLTAIKTKLEDIPFDANGDFPMYGKESDLYTYNAIKERYLSHKKDKRKSFQEPLYKPTKSGGIGPLIKSIKIMDTRTIVNPVNQGKGVVYNSKIARTDVFKKEEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLIEKYQVDVLGNYTKIKEEKRIGLTTYNDNKKIAAC

SEQ ID NO: 816 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 817 - protein, 1069 aa, Bacillus thuringiensis
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLRVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 818 - protein, 206 aa, Bacteroides cellulosilyticus
MKKILGLDLGCNSIGWALVNEAENTEEISSIIKLGVRVNPLTVDEMQNFEKGKSITTNADRTLKRSMRRNLQRYKLRRDTLIEVLKEHGFITDSTLLSEHGNKTTFETYRLRAKAAVEEISLEKFARVLLMINKKRGYKSSRKAKGSEDGVLIDGMDVARKLYEEGLTPGELCLQILEAGKKNLPDFYRSDLQNEFDRIWNFQKLV

SEQ ID NO: 819 - protein, 349 aa, Bacteroides coprosuis
MKKILGLDIGTNSVGWAVVNTNQEGEPSQIEKLGSRIIPMSQDILDKFGQGQTVSSTASRTDYRGIRRLRERSLLRRERLHRVLHILDFLPKHYADSIGWDPRNSKTYGKFLPGTEVKLAWVPTADGHQFLFYSTYLEMLEDLKQTQAQLFETSQTPVPLDWTIYYLRKKALTQPITKHELAWLLLHFNTKRGYYQRRGELEDTPTDKLVEYHALKVVDVEVDPEDQSKKPWYFVHLENGWIYKRQSSEPLDNWKGLVKEFIVTTHLDKEGKPKLDKEGEVRRSFSSPKEDDWTLVKKKTENDLEKSGLTVGAYIYQTLLNKPNQKIRGGLIKHIERNYYVEELEQILR

SEQ ID NO: 820 - protein, 1504 aa, Bacteroides coprosuis
MKKVLGLDIGTNSVGWAVVNQNDKGEFLSIEKIGSRIIPMSQDVMDKFGAGQTESSTAQRTQYRGVRRLRERSLLRRERLHRVLHILHFLPQHYDAAIGWNKKENKTYGKFLPGVEVNIPWVATDQGHQFIFMDSYAEMLKDLKQHQPHLFEKSSTPVPLDWTIYYLRKKALTQAISKEELAWILLNFNQKRGYYQLRGEEVEDNTKREEFYALKVVKVELDKDNTSAKTWYKVHLENGFIYPCPSDTPIDSWVGMVKDFIVTTTLEKDGSEKRTADGEIKRSFRAPKEDDWTLLKKKTESELEKSGKQVGAFIYDTLLSNPDQKIIGGLIKTIERKYYKKELEQILETQQKFIAELSDKKLFQACAEELYPLNDSHRENLLERDFKHLFVQDIIFYHRPLKTKKSLISNCTYEYRTFYKNGEKQISPIKCIAKSNPLFQEFRVWQFVQNLRILQRQRSEGDSIKYNVDVTAEFLKDENDIANLFTWLNERKVIKQDQLLKSYFKLKVNKETKELDYRWNYVDDKNKEYPCNATRTHILSFLEKCKEEKRIEDDRFVYSLWHLLYSVVEPIELRGALAKFAEREHLHPSFVDVFAQFPPLEKEYGSYSEKAIKRLLPLMRMGDYWHEDKIDVKTKQRIQRIIDGEADDDITHRSREKVENLRSITDFKGLPLWKAGYVVYNRHSESGELTKWKTPHELSNYIQNEFKQYSLRNPIVEQIVLETLRVVHDLWVKHGDFSEIHLELGRDIKNSSDKRKRMAERQQENENSRQRVLEMLIDLKKEAAFADLNPYSPSQQEKLRIVEDGVLRSNIEIPKDIEKITKSAKPTSRELTKYRLWLDQKYRSPYTGQPISLAQLFTSKYEIEHVIPQAKYFDDSFTNKVICESEVNKEKGSMLAHEFILKNGGSTVNVGGRQVQVLKNDAYVELINRLYGKNNPVKAKKLLAEDIDEVVGDFSERQLNDTRYISRVVQKLLSNIVREEDEQESTSKHVIGCSGQVTTALKKDWGLNDIWNKIIQPRFERLNEMTATEDYGVWQSPNHFQIRVPEEIQKGFTKKRIDHRHHAMDALVIACATRSHINYISNRSGQDRNAKFETTRTDLRSKLCYKENSSGNNYNYIFNKPWDTFTQDAHRALENIVVSHKQNLRVLTKTNNYTQFINKDGKKDLQKQVKGDHFAVRKPMHQETIYGRVSIRSIKEVALKKALENWKQIVDRTLKDKIRELIGAYGKYDAQTILKYFKDRDYKFNNLKINRVEVYEYDHNCAAVRKSIGDDLTIKQIERITDESIRKILMNHLSNYDDNLKEAFSPEGLMEMNKNIKELNGGKNHQPIYKVRLFEDLGSKFPLGVSHNNPDKYAIAAKGTNLFFGIYEDQEGKRMFDSIPLNIVIDRLKEKKSPVPETYNESKLKFHLSPNDLVYVPTDEEQKQPELVDVDHLSDEQKGRVYKAVSFTGNRAFFVNHRVSKVIHDYVEFGTKNKIENDDDKRSLKHICWKLKVNRLGEITDVKR

SEQ ID NO: 821 - protein, 1509 aa, Bacteroides eggerthii
MKTILGLDLGTNSVGWAVINSVIKEQAERIWIEMAGSRIIPMDAAVLGDFDKGNSISQTSERTRLRGARRLRERQLLRRERLHKVLNILGFLPNHYLEYIDFEKHPGKFLADAEPKLAWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQVKEFIVTTDLNPDGTPKLDKYGEVKRSFRAPKEDDWMLIKKRTEADIANTHKTVGAYIYDTLLQKPQQKIIGKLVKTVERKLYRDELSLILQKQCAFHAELQDRALYARCVEALYPSNEVRRKNIANRDFVYLLMDDILFYQRPLKTKKSLIANCPYEENEYVDRETGEIKKTPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSSLEKANVCIDFLSNEKEVALWHILYSVSDKQEIEKALRTFAAKNGLDESFVEAFKKFPPFKSEYGAYSAKAIKKMLPLMRCGKYWDVSSIDDTTKERIKKIVTGEYDERISVKVRDKVMNLSDISCFRRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDTVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKLLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKNRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDTPAMIVDKRVKNKVFELLSYKYDKKRIEKYFKENAFLWKELDLAKVAVYYFTEATTEPLVAVRKPLDSTFNEKKIKESVTDTGIQKILLNHLCTKEGKPDLAFSAEGIEEMNRNLLQLNNGKSHQPIYKVRVYEPRGNKFSVGVLGNKGTKWVEAAKGTNLFFAIYITEDGKRTYETIPLNVVIEREKQGLVPVPDRNKKGDKLLFWLSPNDLVYLPTEEEREFGRINEPIDRGRIYKMVSCTGNEGHFIPANVANPIVPVIELGSNNKAQRAWTNEMIKDICIPIKVDRLGHIIEVKYRIDE

SEQ ID NO: 822 - protein, 1526 aa, Bacteroides faecis
MKKILGLDLGTNSIGWAVLNAADDNSLKYIEAAGSRIIPMDAAILGDFDRGNSISQTAERTRIRGMRHLRERYLLRRARLHRILNLLGFLPFHYAQDIDRYGNFSADMEPKIAWCKNLEGELEFIFIESFNEMLEDFRKNQPELVADNKKVPYDWVIYYLRKKALEKKISKEELAWILLNFNQKRGYYQLRGEDDDESMKTAKTRQYFDKQIIKNIIDTNQTYKGQRILIVELQNGDKGKIFKKEIPDWIGQEKNIIVTVDIDKDGNDKYEESGSLSCRFKIPTDAEWESEWKLIKMKTQKDLDESNKTVGTYIYDSILQNPTQKVRGKLVRTIERKYYKAELKQILEKQTEFHSELQDKDLYIECLNELYSNNDTHRNAITDRDFVYLFMNDILFYQRPLKSKKSLIDNCPYERNIYIDKETGEIKYSPIKCIAKSHPLFQEFRLWKFISSIRIYQRESVVEVVDKQLDLFSSQSTSVQKLVTDVDVTDKFLTCENDYVALFEWLNKKKIIDQKEFLKYRPFGLKGDIDNYRWNYVEDKSYPCNETHAMILTYFAKAGISEDILTKEMEEALWHILYSVEDRQEITKALRTFASKYHLSDSFVKVFSNIPPFKKEYGSYSAKAIKKLLSLMRMGKYWSEDAIDVNTRERIDKIVTGEYDEKIRDRVREKTIRLNDIRHFRALPDWLACYVVYDRHSETREITEWKSPEEIDEYIRNFKQHSLRNPIVEQVITETLRTVRDIWKQVGCIDEIHVELGREMKNPADKRKRITSQIIENENANLRVKALLTEFVNSEFEIENVRPYSLSQQDILRIYEDGVLNSVAEVPGDIAGILKKFNENDAKKRPTTSEILRYKLWLEQKYRSPYTGEMIPLSKLFTSAYEIEHVIPQSRYFDDSFSNKVICEAEVNKLKDNALGYEFIKKHHGEKVELGFGKIVEIFSVSVYEQFVKDNYSRNRGKMKKLLMDEIPEQFIERQLNDSRYISKVVKTLLSNVVREKAEQEAVSKNVIVCTGGVTDRLKKDWGINDVWNKIVLPRFLRLNELTNSTNFTAKNAAGNEIPAMPLELQKGFNKKRIDHRHHAMDAIVIACANRNIVNYLNNESASRKAKISRHDLQAILCDKVRTDDKGNYQWRVKKPWDTFTQDVYVALENIIVSFKQNLRVINKTSNYYWHYENGKKVLVKQVKGDSWAIRKPMHKDTVFGEVNLRKVKSVSLNEALKNPQFIVEKDLKRQLLSLLQQNFDIKKIKKYFEEHKDIWSDISLSKMNIYYFTKETKDRYFATRKPLDASFDKKKIESCITDTGIQQILLRHLELKENDPERAFSPDGIDEMNRNIIQLNKGKGHHPIAKVRVYEKADKFEVGQRGNKSSKFVEAAKGTNLFFAVYETEYPDEKTNSIVRKRNYATIPLNIAIERQKRGLSTAPEDEKGNVPSFVLSPNDLVYLPTSEDIVNGHITQPIDKSRIYKMVSSSGSQCFFIKHNIANIIVDKYEFSPLNKMERAISNEMIKEICIPVKVDRLGNIVKLGKSE

SEQ ID NO: 823 - protein, 1509 aa, Bacteroides fluxus
MKTILGLDLGTNSVGWAVINSVIKEQAERIWIEMAGSRIIPMDAAVLGDFDKGNSISQTSERTRLRGVRRLRERQLLRRERLHKVLNILGFLPNHYLEYIDFEKHPGKFLSDAEPKLPWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQIKEFIVTTDLNPDSTPKLDKYGEVKRSFRAPKEDDWMLIKKRTEADIANTHKTVGAYIYDTLLQKPQQKIIGKLVKTVERKLYRDELSLILQKQCAFHAELQDRTLYARCVEALYPNNEVQRRNIANRDFVYLLMDDVLFYQRPLKTKKSLIANCPYEENEYVDRETGEIKKAPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSRLEKANVCIDFLSNEKEVALWHILYSVSDKQEIEKALRTFAAKNGLDESFVEAFKKFPPFKSEYGAYSAKAIKKLLPLMRCGKYWDVSSIDDTTKERIKKIVAGEYDERIAVKVRDKVMNLSDISCFKRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDMVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKMLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKSRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDAPTMIVDKRVKNKVFELLSYKYDKKRIEKYFKENAVLWKELDLARVAVYYFTEATTEPLVAVRKPLDSTFNEKKIKESVTDTGIQKILLNHLCTKEGKPDLAFSAEGIEEMNRNLLQLNNGKRHQPIYKVRVYEPRGNKFSVGVLGNKGTKWVEAAKGTNLFFAIYITEDGKRTYETIPLNMVIEREKQGLAPVPDKNEKGDKLLFWLSPNDLVYLPTEEELEFGRINEPIDRGRIYKMVSSSGNQCFFIPQSISNAIIPTKELGANNKAERSWDGAMIKNICIPVKVDRLGRIIEVKYRINE

SEQ ID NO: 824 - protein, 1436 aa, Bacteroides fragilis; identical to SEQ ID NO: 155

SEQ ID NO: 825 - protein, 1512 aa, Bacteroides nordii
MKNILGLDLGTNSIGWAVINSEEDGPIVKKRIELAGSRIIPMDAAVLGNFDSGVTKSQTAERTSFRSIRRLRERQLLRRERLHKVLQILGFLPEHYVNDIDFENHPGKIKRNTEPKLPWRKNSMGQFEFIFQDSFEAMLTDFATHQPVFVSEGKKVPYDWTLYYLRKKALTEGISKEELAWLILNFNQKRGYYQLRGEEEEEQSNKLVEFYALRVVKVEATDDKKGKDTWYNVHLENGWIYRRTSNIPLDWEGKVKEFIVTTDLNEDGTPKLDKYGEVKRSFRAPKEDDWTLIKKKTESDIANSHKTVGCYIYDALLQNPHQKIKGRLVRTVERKFYKEELRLILEKQLSFHPELQDRDLYRACIDALYVSNEAHKNNISGRDFVYLFIDDIIFYQRPLKTKKSLIDNCPYEENQYMDRETGEVKQAPIKCIAKSHPLFQEFRLWQFISNIRIYQRERVLDDGKLETDVDVTPDFLKTEDDYTTLFEWFNDRKEVDQKAFLKNPQFGLKKTFTEYRWNYVEDKSYPCNETRNAILNGLQKAGVSADFLSREVEEALWHILYSVEDKIEIESALRKFASKHDLDDRFADVFKKLPPFKKEYGAYSAKAIKKLLPLMRIGKYWELSNIDDKTKERIDKIITGEWDENIHDRVREKAIKLSDITDFKGLPLWLSCYVVYNRHSEARAIAKWESPEDIDSYLRLFRQHSLRNPIVEQVITETLRTVRDIWKRVGQIDEIHVELGREIKNPADKRAKMTAQIVENENTNLRIKALLAEFINSEYEIENVRPYSSNQQEKLKIYEDTVLNGVKEIPEDINTILKKFRESDLKKRPTKSDFLHYKLWLEQKYCSPYTGRIIPLGKLFTSAYEIEHIIPQAHYFDDSFSNKVICEAEVNGLKDKKLGYEFIKHNPGKMVEIGFGKPPVRIFSVEEYERFVKENYSGIKNKMNKLLMDDIPETFIERQLNDSRYISKVVKSLLSNIVREKDSNGEYEPEAISKNVIVCTGSVTDRLKRDWGVNDVWNSIIYPRFERLNELTGSQQFGCWENKEGKRVFQTAVPLEMQKGFSKKRIDHRHHAMDAIVIACATRNHINYLSNESASKKAKISRTDLQRLLCTKCRTDDNGNYKWIVKKPWPAFTQDIRKALENITVSFKQNLRVINKTTNYYVHFDESGKKVLEKQINGDSWAIRKPMHKDTVFGKVNLQKVKEVRLSLALDTPKMIVDKKLKEKVLQLYSYKYDKKRIDKYFKENASLWKDLNLSKVAVYYFTNDSTEPLVAVRKPLDTSFNAKKIKESVTDTGIQKILLNHLSNNQDDPNLAFSPDGIDKMNKNLTALNDGKYHQPIYKVRVCEPQGNKFSVGTSGNKTSKYVEAAKGTNLFFAVYQTEDGKRSYETIPLNVVIEREKLGWTPVPENNNNGDKLLFWLSPNDLVYVPTADELNNGMRLDNMDKGRIYKMISCSGPQCFFIPQNVSNAIIPVIELGANNKAEKSWNNEMIKVVCVPIRVDRLGCITQINNQK

SEQ ID NO: 826 - protein, 779 aa, Bacteroides oleiciplenus
MKEGNQYDVACEYAGYRHSKSSLTREEIDNKVLKNRLEILPKNSLRNPVVEKILNQMVNVVNAVIDTYGKPDEIRVELARELKKGAKEREELAKSIAQNTREHEAIRQLLQTEFGMMHVTRNDIIRYKLYEELKDNGYKTLYSDQYIPREKVFSKEIDIEHIIPQARLFDDSLSNKTLEYRAVNIEKGNKTAYDFVKEKYGNDGLRRYLNHCEALFKDKKTKLKKLKMEDQDIPDGFIDRDLRNTQYIAKKALSMLSEISRRVVATTGSITDELRKDWQLVDIMKELNLPKYEALGFVETFKDKDGRIIKKIKDWSKRNDHRHHAMDALTVAFTKDVFIQYFNNKNAFWMSGSKEHANITAIKNKYFEKGKALAPIPLELFRTEAKHHLENILVSIKAKNKVVTNNINRTKKKNGENLKLQQTPRGQLHLESIYGSYRQCIIRDEKVNASFDASKIANVSKSAYRNALLKRLEAYDNDPKKAFTGKNSLDKNPVYLDENKMEKVPDRVKIVEFETVYTIRKPIDPKLSIDKVVDARIRTLLKKRLEEYGGDAQRAFSNIEENPIWLNKEKGISVKRVAIRGISNAQALHDKKDKDGNPILDKEGKGIPTDFVNTSNNHHVAIYRKPVVDKMGQVILDENGSPRYELGEDVISFFEAVARVNLRQPVVDKDYKRSEGWQFLFSMKQNEYFVFPNEKTGFNPKEIDLLNPENYALISPNLFRVQKIGLNDYTFRHHLETSIQNNSNELKFITWIRCGKNGINGVIKVRVNHIGQIVSMGEY

SEQ ID NO: 827 - protein, 653 aa, Bacteroides oleiciplenus
MKKILGLDLGSSSIGWALVNEGANDEEKSSIIKLGVRVNPLTVDEAQNFEKGKSITTNADRTLKRGMRRNLQRYKQRREALVEVLKKHEFITAGTLMSEQGNKTTFETYRLRAKAVEEEISLEEFARVLLMINKKRGYKSSRKAKGDEDGVLIDGMDVAKKLYDEDLNPGELCLQLLEAGKKTLPDFYRSDLQDEFDKIWNFQKQFNPESFCDTAKEEVRGKNRTQTWTILSKYFVWTEGDSVWNNEEARTEERIKEYKLVGIKRTTKGYEQKLENYRWRVQALSEQLNPEIIAIVLQEINGQISASSGYLGAISDRSKELFFNHQTVGQSLMSELDKNPNGSLRNKVFYRQDYLDEFNTIWEKQSLYHKELTVELKKEIRDIIIFYQRRLKSQKGLISTCEFEQREIIVEKDGKRKTKIIGCKVIPRSHPLFQEFKIWQTLNDVEVYVADRRTKRKQDRKSTTLFSDTEDILLVEGKRYLYQEEKELLAKELFVRENMKKAEVLKLLFEDPKELDLNFKQIDGNRTGFALFSAYSKMIEKYGYESVNFKNSADEIIEKLQIIFADLGWNTELFSIDLSKDDKELEKQPYFRLWHLLYSFEGDNTPTGNGKLIEALMRLCSVEKEYASVLANVSFQEDYGSLSAKAIKKYYLI

SEQ ID NO: 828 - protein, 1436 aa, Unknown
  Bacteroides sp. D2
MKRILGLDLGTNSIGWALVDEAENKDERSSIVKLGVRVNPLTVDELTNFEKGKSITTNADRTLKRGMRRNLQRYKLRRETLMEVLKEHKLITEDTILSENGNRTTFETYRLRAKAATEKISLEEFARVLLMINKKRGYKSCRKAKGAEEGTLIDGMDIARELYNNNLTPGELCLQLLDAGKKYLPDFYRSDLQNELDRIWEKQKEYYPEILTEVLKEELRGKKRDAVWAICAKSFVWEEYYTEWNKEKGKTEQQEREHKLEGIYSKRKRDEAKRENLQWRVNGLKEKLSLEQLVIVLQEMNIQINNSSGYLGAISDRSKELYFNKQTVGQYQMEMLDKNPNASLRNMVFYRQDYLDEFNTLWEKQAEYHKELTGELKKEIRDIVIFYQRRLKSQKGLVGFCEFESRQIEVEIDGKKKIKTVGNRVIPRSSPLFQEFKIWQILNNIEVTVVGKKGKRRKQKDNSPTLFDGLDDTEQLELNGSRYLYQEEKELLAQELFVRDKMTKSDVLKLLFDNPQELDLNFKTIDGNKTGYTLFQAYSKMIEMSGHEPVDFKKTVEKVVEHVKAVFDLLNWNTDILGFNSNEELDNQSYYKLWHLLYSFEGDNTPTGNARLVQKITELYGFEKEYAIILANVTFQDDYGSLSAKAIHKILPHLKEGNRYDVACAYAGYKHSESSLTKEEIANKALKDRLTLLPKNNLRNPVVEKILNQMVNVINAIIDTYGKPDEIRVELARELKKNAKEREELTKFIAETTRKHEEFKILLQSEFGLTNVSRTDILRYKLYKELESCGYKTLYSNTYIPREKLFSKEFDIEHIIPQARLFDDSFSNKTLEARSINLEKGNKTAYDFVKEKFGESGADNSLDHYLNNIEDLFKSGKISKTKYNKLKMAEQDIPDGFINRDLRNTQYIAKKALSMLNEISRRVVATSGTITDKLRQDWQLVDVMKELNWEKYKALGLVEYFEDKDGRQIGRIKDWTKRNDHRHHAMDALTVAFTKDIFIQYFNNKNASLNSNTNEYAIKNKYFQNGRAIAPIPLREFRVEAKKHLENTLISIKAKNKVVTGNINKTKKRGGVNKYLQQTPRGQLHLETIYGSGKQYLTKEEKVNASFDMKKIATVSKSAYRDVLLKRLHENDNDPKKAFTGKNSLDKQPIWLDKEQTRKVPEKVKTVTLETIYTVRKEISPDLKVDKVIDAGVRKILTGRLNEYGNDAKKAFSNLDENPIWLNKEKGISIKRVTISGISNAQSLHVKKDKDGKPILDEDSRNIPVDFVNTGNNHHVAVYRRPVIDKRGQLVIDEAGNPKYELEEVVVSFFEAVTRANLGQPIIDKDYKTSEGWQFLFSMKQNEYFVFPNEKTGFNPKEIDLLDAENYGVISPNLFRVQKFAHKNYVFRHHLETTIKDTSSILKGITWIDFRSSKGLDAIVKVRVNHIGQIVSVGEY

SEQ ID NO: 829 - protein, 1510 aa, Unknown
  Bacteroides sp. D2
MKRILGLDLGTNSIGWALVDSEEQRILGMGSRIIPMDQGVLDTFSGGNPVETQTAARTAYRGTRRLRERALLRRERLIRVLNMMKFLPEHYASQIDFEKRLGQFFDEKEPKLAWKQNDEGRFEFIFQQSFNEMIEEFKNKGVVREDKKIPYDWTIYYLRKKALSQEIEKEELAWILLNFNQKRGYYQLRGEEEEENPNKLVEYYSLKIVDVIADEKPNSKGDIWYSLHLENGWIYRRSSKIPLFGWKDKTRDFIVTTDLNDDGTVKKDKEGIEKRSFRAPSENDWVLLKKKTESDIEKSHKTVGAYVYETLLQNPMQKVRGKLVRTIERKFYKDELKQILEKQREFHPELRDEDLYNDCVRELYRSNETYQFILSKRDFVHLFLDDILFYQRPLRSQKSAIGDCILEFKTYKDKDGNNIKEYLKVISKSNPLYQEFRIWQWLYNLKIYRKEDDEDVTLQFIANIEDKEQLFDFLSNRKSIEQKPLLEYLIKAKGLKKQVKTEAYRWNYVEDKIYPCSETKTMISTRLAKVENIPDNFFTKEIEQKLWHIIYSVTDKNEFEKALRTFAKKYDLDIASFVDNFKKIPPFKNEYGSFSEKAIKKLLPLMRLGKYWKWNDIDNNTQNRISKIITGEYDEEIKDIVREKSIALTNENDFQGLQLWLAQYLVYGRHSEADIAGKWHSVADLEKYLNEFKQHSLRNPIVEQIITETLRVVRDIWRKYGQGAENFFSEIHVELGRDMKNTADERKKIVNVVTENENTNLRIKALLMELKNNSDGKLEVENVRPYSPTQQDILKIYEEYAISTGLDNEKDEKVKEDIKKISRVAQPTTTELQRYKLWLEQKYCSPYTGKVIPLGKLFTEEYQIEHIIPKSRYYDDSFSNKVICEAAVNKLKDKCLGLEFIKNYHGQIVETGFGQKVTIFDEEAYQNFVKQHYAYNRSKRTKLLLEEIPEKMIERQMNDTRYISKFVLPLLSNLVRAEENDNGVNSKNVLPVNGKITTMLKQDWGLNDVWNDLILPRFVRMNELAKTIAFTSWNEQHQKYLPTVPLELSKGFQKKRIDHRHHAMDALVIACATRDHVNLLNNKHANTDTIRYDLQRKLRLFERVTYIDPQTKNNVTKDIPKEFKKPWDNFTVDARNELEKIIVSFKQNLRIINKATNIYTKYENGKKIKVGQKGLNWAIRKPLHKETVFAKVSLRKRKTVRLSEALKDWKKIVDKKLKQEIKRLTCQYGKFDVDTILRYFKDRKYQFGEVDVSKVKMYYFDEENAAVRKNVDTSFTEKFIQGSVTDTGIQKILLNHLEAKGNKVEIAFSPEGIEEMNKNIIQLNEGKLHLPIFKVRVYETIGNKFSVGVKGNKKDKYVEAAKGTNLFFAIYVDENGIRSYETIPLNIVIERLKQGLSVVPEKNRKEHSLLFYLSPNDLVYVPIEDERENIHAVNLDQLNNEQRKRIYKMVSCTGSECHFVPYYVASPIVNKVEYSSLNKIGRSLTGEMIKDVCIKLKVDRLGNVKGISGL

SEQ ID NO: 830 - protein, 1436 aa, Unknown
  Bacteroides sp. 2_1_16
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKETYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSAIFEELNDAEQLELNGSRRLCQEEKELLAQELFVRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKANEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIETVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKIGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 831 - protein, 1424 aa, Unknown
  Bacteroides sp. 3_1_19
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYHSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 832 - protein, 1055 aa, Unknown
  Bacteroides sp. 3_1_33FAA
MRIYRKDLAQDVDVTNELLKTEEDYVALFDWLNGKKEIDQKAFLKYPLFGLKKEVENYRWNYVQDKPYPCNETRSSMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERMDKIITGEYDEKIENRVREKAIHLADVSDFKGLPLWLVCYIVYGRHSEAKEITQWKSPADIDLYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVARQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNHFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKVRWYEQADKFAVGQTGNKSSKFVEAAKGTNLFFAVYESNILDKKTNTIIKKRNYATIPLNVAIERQKQGLPVAPEDENGNDPIFVLSPNDLVYLPTAADLANGIIAQPLDRGRIYKMVSCTGNEGYFIPARIANPILQTIELGSNNKAQKAWTDEMIKEICMPIKVDRLGNVLESSSSYKK

SEQ ID NO: 833 - protein, 1055 aa, Unknown
  Bacteroides sp. 9_1_42FAA
MRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 834 - protein, 286 aa, Bacteroides uniformis
MLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 835 - protein, 1508 aa, Bacteroides uniformis
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKVKVVRLSVALDTPSMIVNKRVKNKVLELLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 836 - protein, 1210 aa, Bacteroides uniformis
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKALIPQHYNLTLFISS

SEQ ID NO: 837 - protein, 1504 aa, Bacteroides vulgatus
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEEENKNKLVEFYALKVVAVEDSGEKKGKDIWYNVHLENGWVYRRTSNMPLDWVGKTKEFIVTTDLEKDGTPKKDKEGNVKRSFRAPKEDDWSLLKKKTEADIDQTHKTVGVYIYDTLLGNPSQKIRGRLVRTIERKYYKEELKQILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIVNLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEITQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSCTGNEGHFIPARIANPILQTIELGSNNKAQKAWTDEMIKEICMPIKVDRLGNVLESSSSYKK

SEQ ID NO: 838 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 839 - protein, 1352 aa, Belliella baltica
MKKILGLDLGTTSIGWAFIKEPEKDVVGSEIVDMGVRIVPLSSDEENDFAKGNTISINADRTLKRGARRNLQRFKQRRNALLEIFKEKKLISTNFKYAEDGPSSTFSTLNLRAKAAKEKIELQDLVKVLLQINKKRGYKSSRKAKSEEDDGSAIDSMGIAKELYENDLTPGQWVYEALQKGRKNVPDFYRSDLQEEFKKIVNYQSEFFPDIFNASFVEDWMGKASTPTKQYFNKKGVQLAENKGKREERRLQEYKWRAEAVNFKIDLSEIALILSQINSQISNSSGYLGAISDRSKELYFKNLTVGQYLYQQIKKNPHTRLKGQVFYRQDYLDEFERIWSVQSSFYPQLNDALKREVRDITIFFQRRLKSQKHLISNCEFEDHHKVVPKSHPVFQEFRIWQNLNNLLLIKKDNLNEKFDLELESKIALANELAFKRELNVKDALKILGLKPNEWEFNFTKIEGNRTNQAFFDAFAKIIELEDGEPIDLGDLKADDILDQFSEAFLRIGIDTELLQVNSDIEGAEYEKQSYIQFWHLLYSSEDDQKLKLNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPELGRPDEIRVEMARELKANAEQRKNMTSNIASATRDHDKYREILKSEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEISRRVSVTTGTITDKLREDWGLVEIMKELNWEKYDKLGLTYTIEGKHGERLNKIKDWSKRNDHRHHAMDALTVALTKPAYIQYLNNLNAKGLNNKKGTEVFAIEQKYLKRENGKLCFIPPIENIRSEAKKHLSRILVSYKAKNKVVTINKNKTKSKAGLNEQIALTPRGQLHKETVYGKSFHYSTKFEKIGASFNVQKINTVAKKEEREALLKRLAENGNDPKKAFTGKNTLNKMPIYLDLGKNIKLSEKVKTVVLEQNYTIRKNIDPDLKVDKVIDVGIKRILESRLEEFGGNAKLAFSNLEENPIWLNKEKGISIKRVKISGVSNVESLHVKKDHFGEPILDQEGNEIPVDFVSTGNNHHVAIYEDENGNLQEEVVSFFEAVVRQNQGLPIIKKNHTLGWKFLFTLKQNEYFVFPSDDFVPADVDLMDEQNYHLISPNLFRVQKIARKNYVFNNHLETKAVDNDLLKSKKELSKITYHFYQTPEHLRGIIKIRINHLGKIIQIGEY

SEQ ID NO: 840 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 841 - protein, 1430 aa, Bergeyella zoohelcum
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVITDWTKRNDHRHHAMDALTVAFTKHNHIQYLNYLNARKNEKHKEHSNIMGIQQLETIKVTDKNGNEKRVFKAPMPNFRQVTKAFLENILISHKAKNKVVTKNKNKVAGSNKVQEVLTPRGQLHKETVYGKYQYYVQKEEKIGAKFDLETIKKVANPLYQSLLKKRLEENGGDPKKAFTGKNSLAKNPIYLDDTQTEQLPEKVKLVWLENSFSIRKDITPENFKDEKLIDKILDEGVKRILKERLQSFGNDAKKAFSDLDKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQKFSKLQYGNSFVREFVFRHHLETTVEDRKELQGITYKQMKNSTFFNDIIKVRINHLGDIVSIGEY

SEQ ID NO: 842 - protein, 1281 aa, Bifidobacterium bifidum
MEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLAFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 843 - protein, 1121 aa, Bifidobacterium dentium
MSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 844 - protein, 354 aa, Bifidobacterium longum
AKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWV

SEQ ID NO: 845 - protein, 1124 aa, Bifidobacterium longum
LTGHSGHTFWPTSSSPPIQLEQEKRPLPQRNTSQNGHTFWPITRERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFPVSMLMVRLASIYNSSRSLVEGTLHGNIGLLMDSLTRRS

SEQ ID NO: 846 - protein, 166 aa, Bifidobacterium longum
MGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPA

SEQ ID NO: 847 - protein, 1138 aa, Bifidobacterium longum
MNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 848 - protein, 182 aa, Bifidobacterium longum
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPA

SEQ ID NO: 849 - protein, 441 aa, Bifidobacterium longum
MVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRM

SEQ ID NO: 850 - protein, 967 aa, Bifidobacterium longum
MVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 851 - protein, 1151 aa, Unknown
  Bifidobacterium sp. 12_1_47BFAA
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 852 - protein, 1092 aa, Brevibacillus laterosporus
MAYTMGIDVGIASCGWAIVDLERQRIIDIGVRTFEKAENPKNGEALAVPRREARSSRRRLRRKKHRIERLKYMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRASLLVEIHTLFESQRQHHNFLASKDFELEYINIWSSQRPVATKDQIEKMIGTCTFLPKEKRAPKASWHFQYFMLLQTINHIRITNAQGTRPLNKEEIEQVVNMALTKSKVSYHDIRKVLDLSEEYQFVGLDYGKEDEKKKVESKETIIKLDDYHKLNKIFNEVELAKGETWEAVDYDTVAYALTFFKDDEDIRDYLQNKYKDSKNRLVKNVANKEYTNELIEKVSTLSFRKVGHLSLKALRKIIPFLEQGMTYDKACQAAGFNFQGISKKKRSVVLPVIDQISNPVVNRALTQTRKVINALIKKYGSPETIHIETARELSKRFDERKNITKDYKENRDKNERAKKHLSELGIINPTGLDIVKYKLWCEQQGRCMYSNQPISFERLRESGYTEVDHIIPYSRSMNDSYNNRVLVMTRENREKSNQTPYEYMGNDTQRWDEFEQRVTTNPQIKKEKRQNLLLKGFTNRRELEMLERNLNDTRHITKYLSHFISTNLEFSPSDKKKKVVNTSGRITSHLRSRWGLEKNREQNDLHHAMDAVVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNAKKAFSTDLHKPKKDGTKGPLIKSVRIMENKTLVHPVNKGKGVVYNSSIVRTDVFQRKEKYYLLPVYVTDVTKGKLPNKVIAAKKGYDDWIEVDDSFTFLYSLYPNDLIFIRQNPKKKISLKKRIESHSISDSKEVQEILTYYKGVDSSTAAIEFITHDGSYYAKGVGVQNLDCFEKYQVDILGNYSKVKGEKRLELETSDNNHKGKDVNSIKSTSR

SEQ ID NO: 853 - protein, 103 aa, Butyrivibrio fibrisolvens
MISVGQSRKDLEDLGYEFKLSFYKEDIIEYEKNGDILVERFLSRTMPQVRNYIETKPIDRPKYDKRNPVGLSKTSSIRKITMDILGNRFYVDKMSFNNVVGTQ

SEQ ID NO: 854 - protein, 177 aa, Butyrivibrio fibrisolvens
MLIAFSQMGYDAYHELTNKYIDFETGEIIDKEGFNELLNNDLVYKNTMYESKWLKIKGNIEKAAEKNKYWYQVNKKCNRGLCNQTVYGTRESDGDVYKISKIDIRTDDGFKKFKNIVDKGNESVFLMYENDPKTFELIMDIYKNYSDSKNPFVQYEKETGDIIRKYSKKITGQRFLN

SEQ ID NO: 855 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 856 - protein, 984 aa, Campylobacter coli
MARILAFDIGISSIGWAFSENDELKDCGVRIFTKAENPKTGESLALPRRLARSARKCLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 857 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 858 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 859 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 860 - protein, 987 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 861 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 862 - protein, 987 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 863 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLTNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 864 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 865 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVVLSSGMITQMLRNFWYLGFKNHKNYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANTKGSLVRTDLFVDKENKFHAVSIYKADFSTKKLPNKTPATTSNGETKEGIEMNENYNFCMSLYKNTPVSVKIKGMKEPIICYYHGFNTSGSKITYKKHDNNYHNLSEDEMVVFRKNDKESIVVGKILEIKKYSISPSGELSLIENEKRKWF

SEQ ID NO: 866 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKILTFKKLNDLKQGKTPFEAFGEDEKLWAEINERIKEYNGKKRFKIFDKFFKDKKPFDFTEQTLQDTRWLTKLVASYLNEYLLFLPINEDENTALGYGEKGSKQHVVLSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 867 - protein, 933 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSVIILHIAKHRGYDDSALKNENGTIIEALNKNKETMLKFKSVGEYFYKNFVQNKEVKKIRNTTEDYSNSVPRSLLKQELDLILDRQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEHLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANANGSLVRSDLFIDKKNKFHAVPIYKADFSTKKLPNKTPATTSNGETKEGIEMNENYNFCMSLYKNTPISVKIKGMKESIICYYHGFNTSGSKITYKKHDNNYHNLSEDEMVVFRKNDKE

SEQ ID NO: 868 - protein, 666 aa, Campylobacter jejuni
KGEKGTYFIEFKKYKEFIKALDEHSLSQDDLNEIAKDITLIKDEIKLKKALAKYDLKENQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFAKQNQEKLNKTPFEAFGNDSTKWQKIEVLTKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDEDYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 869 - protein, 190 aa, Campylobacter jejuni
MAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKKVMNAA

SEQ ID NO: 870 - protein, 985 aa, Campylobacter jejuni
MAKILAFDIGISSIGWAFVENDELKDCGVRIFTKAENPKTGESLALPRRLARSARKRLARRKARLNHLKHLIANEFKLNYEDYQSFDESLAKAYKGTLISPYELRFKALNELLSKQDLARVILHIAKRRGYDNIKNSDDKEKGAILKAVKENEEKLANYKSVGEYLYKEYFQKFKENSKEFINVRNKKESYERCIAQSFLKDELKLIFQKQREFGFNFSKKFEEEVLSVAFYKRALKDFSHLVGNCSFFVDEKRAPKNSPLAFEFVALTRIVNLLNNLNKNNSYIKDDLNALLSEVLKNGTLTYKQTKKILGLSDDYEFKGQKGNYFIEFKKYKEFIKALCEHNLNQDDLNEIAKDITLVKDETKLKKALAKYDLNQNQIENLSKIEFKDHLNISFKALKLIVPLMREGKKYDEVCNELNLKTAINEDKKEFLPAFNETYYKDEVNNPVVLRAIKEYRKVLNSLLKKYGKVHKINIELAREVGKNHRERSKIEKEQNENFKAKKDAELECEKLGLKINSKNILKLRLFKEQKEFCVYSGEKIKISDLQDEKMLEIDHIYPYSRSFDDSYMNKVLVFTKQNQEKLNKTPFEAFGKDDVKWQKIETLAKNLPAKKQKRILDKNYKDKEQKDFKDRNLNDTRYIARLVLNYTKDYLEFLPLSDDENIKLNDTQKGSKVHVEAKSGMLTSVLRHTWGFSTKDRNNHLHHAIDAVIIAYANASVVKAFSDFKKEQENYTAELYAKKINELDFKNKRKFFEPFSNFRQKVLEKIDEIFVSKPERKKPSGALHEETFYKEEEFYKEYGGKEGVLKALELGKIRKVNGKIVSNANMFRVDIFKYKKTNKFYAVPIYTMDFALGILPNKAVVGGKDKQGIIKDWLLMDENYEFCFSLYKDSLILLQTKDMQEPELVYFKSFKSSTAGLVVSKHDNKFENLNENQKKLFKSANEKKVVAEGIGIQNLKVFEKYIVSALGEITKAEIKERENFKKK

SEQ ID NO: 871 - protein, 987 aa, Campylobacter jejuni
MARILAFDIGISSIGWAFSENDELKDCGVRIFTKAENPKTGESLALPRCLARSARKRLARRKARLNHLKHLIANEFKLNYEDYQSFDESLAKAYKGSLISPYELRFRALNELLSKQDFARVILHIAKRRGYDDIKNNGDEEKGEILKAIKQNEEKLVSYQSVGEYLYKEYFQKFKENSKEFINVRNKKESYERCIAQSFLKDELKLIFQKQRKFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKIVSNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 872 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDEGLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 873 - protein, 961 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNIGFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKLSDLQDEKMLEIDHIYPYSRSFDDSYMNKVLVFTKQNQEKLNKTPFEAFGNDNVKWQKIEVLAKNLPEKKQKRILDKNYKDKEQKDFKDRNLNDTRYIARLVLNYTKDYLDFLPLSDDENTKLKGSKVHVEAKSGMLTSALRHTWGFSTKDRNNHLHHAIDAAIIAYANNSIVKDFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNLKVFEKYIVSALGEVTKAEFRQREDFKNELR

SEQ ID NO: 874 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 875 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVSYQSVGEYLYKEYFQKFKENSKEFINVRNKKESYERCIAQSFLKDELKLIFQKQREFGFSFSKKFEEEVLSVAFYKRALKDFSHLVGNCSFLLMKKERQKNSPLAFMFVALTRIINLLNNLKNTEGILYTKDDLNTLLNEALKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKMVKNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 876 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYPVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 877 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFHQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 878 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 879 - protein, 861 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFLCCANLYYGFCFKSITK

SEQ ID NO: 880 - protein, 462 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKS

SEQ ID NO: 881 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALDEHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNKTPFEAFGNDGVKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLVVSKHDNKFETLSKNQKILFKNANEKEVIAKSIGIQNLKVFEKYIVSALGEVTKAEFRQREDFKK

SEQ ID NO: 882 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 883 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGLKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 884 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHTIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 885 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTFLNEVLKNGTLTYKQTKKLLGLSDDYEFKGEKGTYFIEFKKYKEFIKALGDHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 886 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKSLGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 887 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALVKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 888 - protein, 983 aa, Campylobacter jejuni; identical to SEQ ID NO: 231

SEQ ID NO: 889 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLVNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSEKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 890 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDNIKNSDNEEKSEILKAIKQNEEKLVNYQSVGEYLYKEYFQKFKENSKEFINVRNKKESYERCIAQSFLKDELKLIFQKQREFGLSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVVINEDKKDFLPAFNETYYKDEVTNPVVLRAIKEYRKVLNALLKKYGKVHKINIELAREVGKNHSQRAKIEKEQNENYKAKKDAELECEKLGLKINNKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPTKKQKRILDKNYKDKEQKDFKDRNLNDTRYIARLVLNYTKDYLDFLPLSDDENTKLNDIQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 891 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAEFECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 892 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGTILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 893 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFNESLAKAYKGSLISPYELRFRALNELLSKQDFARVILHIAKRRGYDDIKNSDDKEKGAILKVIKQNEEKLANYQSVGEYLYKEYFQKFKENSKEFTNVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 894 - protein, 984 aa, Campylobacter jejuni
MARILAFDIGISSIGWAFSENDELKDCGVRIFTKAENPKTGESLALPRRLARSARKRLARRKARLNRLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLNQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 895 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFLKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 896 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 897 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 898 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVTLTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 899 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFIQREDFKK

SEQ ID NO: 900 - protein, 987 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRVPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYGVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 901 - protein, 984 aa, Campylobacter jejuni
MARILAFDIGISSIGWAFSENDELKDCGVRIFTKVENPKTGESLALPRRLARSARKRLARRKVRLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 902 - protein, 721 aa, Campylobacter jejuni
MFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNNTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 903 - protein, 512 aa, Campylobacter jejuni
MHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 904 - protein, 965 aa, Campylobacter jejuni
MKIIGFNLGIANIGWALRENDEIIDCGVRVFDIPENPKNGNSLALERRENKARMKIVKRKKARMLATKTFLKKELNVDLSKLFLIGSTQSIYELRAKALSSLISKEELSAIILHIAKHRGYDDSALKNENGTIIEALNKNKETMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQEINFKGLDYSKNNVENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKSEYLPLFEKTRFAKDISSPVVIRAICEFRKLLNDIIRRYGSVHKIHLELTRDFGISFSDRKKIIKEIEQNEQSRIKALETIKELKLEETSKNIQIVRLFEDQKGICPYSGLKMDLNRLDELVIDYIRPYNRSLDDSYSNKVLTFKKLSDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHDLTPLKIKELKNTYGDLDLAVKLGKIRKYNDKYYANANGSLVRADLFVDKKNKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIAVGKILEIKKYSISPSGELSLIENEERKWF

SEQ ID NO: 905 - protein, 759 aa, Campylobacter jejuni
MLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFESFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 906 - protein, 984 aa, Campylobacter jejuni
MVRILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 907 - protein, 1003 aa, Campylobacter lari]
MRILGFDIGINSIGWAFVENDELKDCGVRIFTKAENPKNKESLALPRRNARSSRRRLKRRKARLIAIKRILAKELKLNYKDYVAADGELPKAYEGSLASVYELRYKALTQNLETKDLARVILHIAKHRGYMNKNEKKSNDAKKGKILSALKNNALKLENYQSVGEYFYKEFFQKYKKNTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEVLNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYDEACEIANLKPKTVDEKKDFLPAFCDSIFAHELSNPVVNRAISEYRKVLNALLKKYGKVHKIHLELARDVGLSKKAREKIEKEQKENQAVNAWALKECENIGLKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQEDFISRNLNDTRYIATLIAKYTKEYLNFLLLSENENANLKSGEKGSKIHVQTISGMLTSVLRHTWGFDKKDRNNHLHHALDAIIVAYSTNSIIKAFSDFRKNQELLKARFYAKELTSDNYKHQVKFFEPFKSFREKILSKIDEIFVSKPPRKRARRALHKDTFHSENKIIDKCSYNSKEGLQIALSCGRVRKIGTKYVENDTIVRVDIFKKQNKFYAIPIYAMDFALGILPNKIVITGKDKNNNPKQWQTIDESYEFCFSLYKNDLILLQKKNMQEPEFAYYNDFSISTSSICVEKHDNKFENLTSNQKLLFSNAKEGSVKVESLGIQNLKVFEKYIITPLGDKIKADFQPRENISLKTSKKYGLR

SEQ ID NO: 908 - protein, 372 aa, candidate division
DNESAINQIAYILTTQKADEGIRAELDSLPLSDKAKKAIVKIKPTNFKAFGHLSIKALQKITPHILEGMTYDKACEAAGYDFKKQSASLEQITNPVVKRAITQTLKVVRAIERKYGKPYFIKVETARDLAKNFKDRNAIKKENEENQGYNEDIKSIITNGYEASPKTKGGKQLLNHLKEFNVRLNKNADFNGQQIIKVKLYREQQGKCLYSGNPIDFETMLRDDNAYQVDHIVPFSRSNNDGITNKVLVFTEENQKKADRTPFEYFGTDERRWEKFVALVETTYKTRDVKTSDKATNAINYEYNGYAMKKKQNLLLQDYKNDSWNVRALNDTRYITRFIQNYLRQNVDFAEGEEKQRIIAPNGTTTAYLRKR

SEQ ID NO: 909 - protein, 1117 aa, Capnocytophaga ochracea
MKHILGLDLGSNSIGWAFVQQDFENKQGKIIATGSRIIPMDQGILGDFERGNTVSQTAERTTYRSMRRLRERHLLRRERLHRVLHLLGFLPPHYDAQIDFTKRYGKFIDNAEPKIAYNNGNFIFMNSFNEMVEDFKKHQPQLFYKKSNGEESRIPYDWTIYYLRKKALSQKITQQELAWLILHFNQKRGYYQLRGEEETENPNKEVAFHSLKVVDVEAEAPNKKGEIWYTIRLENGWIYRRTSKNPLDDWKGKTRDFIVTTDLNDDGTIKLDKEGKEKRSFRAPDENDWNLLKKKTEHDIDFSGKPVGTYIYDHLLQNPNQKIKGKLVRTIERKYYKDELKAILAKQIALQPELFTETLLADCIRELYRKNETQQQNLLSKDFLHLFVEDIIFYQRPLCSKKSTIANCTLEKRSYIDKETNERKDAPIKVCAKSNPYYQEFRVLQWLQNLRIYEIETDREVTAEFIETPQDYEALFNFLMSQKEIDNEGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYSGGQANFFDEIHIELGRELKKTAEERKQLSDKNQENENTNLRIKKLLAELKEDASIQNVRPYSLVQQELLKIYEEGVFSSTDEIEEDIQKIRKKVEPTPPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKCISEILSKIVRSDEKDEGVNSKNIIPCTGKITTALKQDWGLNDVWNELILPRFERMNQLTQTQLFTSYNDRLQKNLPTVPIEYSQGFQKKRIDHRHHAMDALVIACATREHINYMNNQHALDKSKDKKEKQQSRIDLHPL

SEQ ID NO: 910 - protein, 303 aa, Capnocytophaga ochracea
MSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKEKRTYATIPLNEVIERQKQGLPSVPERNEKGEPLLFSLSPNDLVYVPMEGEIAETIDFNNLSKEQKERIYKTVSFTGNQCFFVQEAVASPIVNKMEYSPLNKMERDILGIMIKEVCVKLKVDRLGNIIKA

SEQ ID NO: 911 - protein, 1471 aa, Unknown
  Capnocytophaga sp. oral taxon 324 str. F0483
MCKYFYIKNFITFVLSKSIIPMKHILGLDLGSNSIGWAFVQQDFENKQGKIIATGSRIIPMDQGILGDFERGNTVSQTAERTTYRSTRRLRERHLLRRERLHRVLHILGFLPPHYDAQIDFTKRYGKFIDNAEPKIAYNNGNFIFMNSFNEMIEDFKKHQPQLFYKKSNGEESKIPYDWTIYYLRKKALSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDAPIKVCAKSNPYYQEFRVLQWLQNLRIYEIETDREVTAEFIETPQDCEALFNFLMSQKEIDNKGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYGGGQANFFDEIHIELGRELKKTAEERKQLSDKNQENESTNLRIKKLLAELKEDASIQNVRPYSLVQQELLKIYEEGVFSATDEVEEDIQKIRKKAEPSKADLQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNKLILPRFERMNQLTQTQLFTSYNDRLQKNLPTVPIEYSQGFQKKRIDHRHHAMDALVIACATREHINYMNNQHALDKSKDKKEKQQSRIDLRTILCEKKNNNWQFKKPWSTFTQEAKEALEHIVVSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSTEGLEELNKNIAQYNNGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 912 - protein, 1450 aa, Unknown
  Capnocytophaga sp. oral taxon 412 str. F0487
MKHILGLDLGSNSIGWAFVQQDFENKQGKIIATGSRIIPMDQGILGDFERGNTVSQTAERTTYRNTRRLRERHLLRRERLHRVLHILGFLPPHYDSQIDFTKRYGKFIDNAEPKIAYNNGNFIFMNSFNEMIEDFKKYQPQLFYKKSNGEESKIPYDWTIYYLRKKALSQKITQQELAWLILHFNQKRGYYQLRGEEETENPNKEVAFHSLEVVDVEAEAPNKKGEIWYTIRLENGWIYRRTSKIPLDDWKGKTRDFIVTTDLNDDGTIKLDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTPIKVCAKSNPYYQEFRVLQWLQNLRIYEIETDREVTAEFIETAQDNEALFNFLMSQKEIDNESLLKYFLFAKNPQIKDKVAKSELKKWLTTYRWNYVYDAADNSSKKYPMNETGYELQQYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSETCFQGLPLWLAQYVVYNRHAEAADIEKWTSVNDLEAYLEDFKQHSLRNPIVEQVITETLRVVRDIWQRYGGGQANFFDEIHIELGRELKKTAEERKQLSNRNQENENTNLRIKKLLAELKEDASIQNVRPYSPVQQELLKIYEEGVFSATDEVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNELILPRFERMNQLTQTQLFTSYNDRFQKNLPTVPIEYSQGFQKKRIDHRHHAMDALVIACATREHINYMNNQHALDKSKDKKEKQQSRIDLRTILCEKKNNNWQFKKPWSTFTQEAQEALEHIVVSFKQNLRVINKATNYYEKWEEKNGVLVKKKVKQEGTNWAIRKPLHKETVSGKIVLDRKIGKDKILTATRKSVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKIEYSPLNKMERDILGTMIKEVCIKLKVDRLGNITKA

SEQ ID NO: 913 - protein, 1435 aa, Unknown
  Capnocytophaga sp. oral taxon 329 str. F0087
MKNILGLDLGTTSIGFAHIVEDENKEKSEIKELGVRIVSLATDEQSDFEKGKSISTNANRTLKHGARLNLDRYQQRRKFLIDLLQKANLITSASILAENGKNTTHSTWQLRAKAVTERIEKEEFARVLLAINKKRGYKNSRKTKTEDEGQAIDGMAIAKCLYDENLTPGQLSLQLLQQNKKLLPDFYRSDLQKEFDLVWNLQKQFYPDILTDSFYKELQGKGKDATSKAFSKRYHFDTAENKGSKESVRLQAYQWRAEAISKQLSKEEVAYVLTEINNNLNNSSGYLGAISDRSKELYFNRQTVGQYLYAQLQENRHNSLKNKVFYRQDYLDEFERIWETQASFHKELTDELKKQIRDVVIFYQRKLKSQKGLVSFCEFESKEIEIEKDGKAITKSIGARVVPKSSPLFQEFKIWQILNNVTCKRKGIRKKKSSAKSTELDLFNEPSQSIFSLDMECKQLLFDELNLKGDLKSDKVLKLLGYSPQEWEINYNQLEGNRTQKSLYEAYLKIIEIEGYEVKDILQIKSTKDDWSLDESPLSASEIRERVKVIFQTLGICTKILYFDPLLPVKEFEQQYSYQLWHLLYSYESDDSTSGNETLYRILEKKYAFKREHATILANVALQDDYGSLSTKAIRKIYPYIKENQYSTACELAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISEKLQKQFGIKNPTKSDIIRYRLYQELEHNGYKELYTNTYIAPDVLFSKNIDIEHIVPKARVFDDSFSNKTLAFKEFNIKKGESTAFDYITSLNCEGELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKDGNKVTVIKDWTKRNDHRHHAMDALTVAFTKPSYIQYLNHLNARKDENNKNYSVILAIEKKETIKVPINNGKNKRVFIEPILNFRQVAKKHLEEIFISHKAKNKVVTKNINKPAGTDKQQITLTPRGQLHKETIYGKYQYYVNKEEKVGVKFDERTITKVSNPLYREALLKRLQANDNDPKKAFAGKNALSKNPIYLDEAKTKTLPEKVNLTYLEEDFSIRKDISPDNFKDLKSIEKVIDQGVKRILIKRLQAYDNDPKKAFVDLEKNPIWLNKEKGIAIKRVTISGVSNAQPLHIGKDHLGKTTLNKEGKEVPVDYVSTGNNHHVAIYRDKEGNLQEQIVSFFEAVVRAQQGLPIIDKNYKQAEGWQFMFTMKQNEMFVFPNEATGFNPAEIDLLDPKNKKLISPNLFRVQTISIVKYGNSVVRDFKFRHHLETTLQDDKILQGITFQQIKSLEPLRNIVKVRINHLGDIVNIGEY

SEQ ID NO: 914 - protein, 1432 aa, Unknown
  Capnocytophaga sp. oral taxon 380 str. F0488
MKNILGLDLGTTSIGFAHIVEDENKEKSEIKELGVRIVSLTTDEQSDFEKGKSITTNANRTLKHGARLNLDRYQQRRKYLIDLLHKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTAENKGSKESVRLQAYQWRAEAVSKQLSKEEVAYVLTEINNNLNNASGYLGAISDRSKELYFNRQTVGQYLYAQLQENRHNSLKNKVFYRQDYLDEFERIWETQALFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSTKDDWSLDESPLSASEIRESVKAIFQALGICTKILYFDPLLPVKDFEEQDSYQLWHLLYSYESDDSTSGNETLYRILEKKYAFKREHARILANVALQDDYGSLSTKAIRKIYPNIKENQYSTACEMAGYKHSKLSLTTEELEARELKNIIPLLKKNALRNPVVEKILNQMINVVNALIEKNSERDAEGKITKYFHFDEIRIELARELKKNAQKRYEMTQNINKAKSEHQKISEILQKEFGIKNPTKSDIIRYRLYKELEHNGYKELYTNTYIAPDVLFSKNIDIEHIVPKARVFDDSFSNKTLAFKDFNIKKGESTAFDYITSLKNEEKLNQYLARVENAYKTKNISPAKYKNLLKKASEIGDGFINRDLRDTQYIAKKAKEILFQVTKNVLSTSGSITDRLREDWSLVDVMKELNMPKYQSLGLTEVEERKDGNKVTVIKDWTKRNDHRHHAMDALTVAFTKPSYIQYLNHLNARKDENNKNYSVILAIEKKETIKVPTNNGKNKRVFIEPIPNFRQVAKKHLEEIFISHKAKNKVVTKNTNKPAGTNKQQITLTPRGQLHKETIYGKYQYYVNKEEKVGVKFDKETIAKVSNPLYREALLKRLQANDNDPKKAFTGKNALSKNPIYLDEAKTKTLPEKVNLTYLEEDFSVRKKIVPKNPTSKEFVPNLKSIEKVVDEGVRNILIERLRVYNNDPEKAFVDLEKNPIWLNKEKGIAIKRVTISGVNNAQPLHIGKDHLGKTTLNKEGKEIPVDYVSTGNNHHVAIYRDKEGNLQEQIVSFFEAVVRTQQGLPIIDKTYKQEEGWQFLFTMKQNEMFVFPNEATGFNPAEIDLLDPKNKKQISPNLFRVQKIATKDYFFRHHLETNVETDNVLKNTTWKREGLSGLKDIVKVRINHLGDIVSIGEY

SEQ ID NO: 915 - protein, 1426 aa, Unknown
  Capnocytophaga sp. oral taxon 335 str. F0486
MKNILGLDLGTTSIGFTHIVEDENKEKSEIKELGVRIVSLTTDEQSDFEKGKSISTNANRTLKHGARLNLDRYQQRRKFLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQKEFDLVWNFQKQFYPDILTDSFYKELQGKGKDATSKAFSKRYHFDTAENKGSRESVRLQAYQWRAEAISKQLSKEEVAYVLTEINNNLNNASGYLGAISDRSKELYFNRQTVGQYLYAQLQENKHNSLKNKVFYRQDYLDEFERIWETQASFHKELTEELKKQIRDVVIFYQRKLKSQKGLISFCEFESKEIEIEKDGKTITKSIGARVVPKSSPLFQEFKIWQILNNVTCKRKGIRKKKSSAKSTELDLFNEPSQTIFSLDMECKQLLFEELNLKGDLKSDKVLKLLGYSPQEWEINYNQLEGNRTQKALYEAYLKIVEMEAHDVKDILQIKSTKDDWALEESPLSASEIRERVKAIFQTLGICTKILYFDPLLPVKEFEEQDSYQLWHLLYSYESDDSTSGNETLYRILEKKYAFKREHATILANVTLQDDYGSLSTKAIRKIYPYIKENQYSTACEKAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISGILQKEFGIKNPTKSDITRYRLYQELAHNGYNDLYTNTYIPKELLFSKNIDIEHIVSKARVFDDSFSNKTLAFREFNIKKGESTAFDYITSLNNEEELNQYLNRVENAYKTKNISPAKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDKNNKNYSVILAIEEKETIKVPTNNGKNKRVFIEPIPNFRQVAKKHLEEIFISHKAKNKVVTKNTNKPAGTDKQQITLTPRGQLHKETVYGKYQYYVNKEEKIGVKFDKETIAKVSNPVYREALLKRLQANDNDPKKAFAGKNALSKNPIYLDEAKTKTLTEKVNLTYLEEDFSIRKDISPDNFKDLKSIEKVIDQGVKRILIKRLQDYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFEAVVGAQQGLPIVDKTYKQAEGWQFLFTMKQNEMFVFPNEATGFNPAEIDLLDPKNKKQISPNLFRVQKIATKDYFFRHHLETNVDTDNVLKNTTWKREGLSGLKDIVKVRINHLGDIVSIGEY

SEQ ID NO: 916 - protein, 1450 aa, Unknown
  Capnocytophaga sp. oral taxon 326 str. F0382
MKRILGLDLGSNSIGWAFVEQDFENKQGKIIATGSRIIPMDQGILGDFEKGNTVSQTAERTTYRSMRRLRERHLLRRERLHRVLHILGFLPPHYDAQIDFTKRYGKFIDNAEPKIAYNNGNFIFMNSFNEMIEDFKKYQPQLFYKKSNGEESKIPYDWTIYYLRKKVLSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTFIKVCAKSNPYYQEFRVLQWLQNLRIYEIETDREVTAEFIETAEDYEALFNFLMSQKEIDNEGLLKYFLFAKNPQIKDKVAKSELKKWLTTYRWNYVYDAADNSSKKYPMNETGYDLQRYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSESCFQGLPLWLAQYVVYNRHAEATDIEKWTSVSDLETYLEDFKQHSLRNPIVEQVVTETLRVVRDIWQQYGGGQANFFDEIHIELGRELKKTAEERKQLSNRNQENENTNLRIKKLLAELKEDASIQNVRPYSPVQQELLKIYEEGVFSSTDQVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITGNKEVTIFTEEQYKEFVKKHYANNSAKQQKLLLNEIPEKMVARQLNDTRYISKYISEILSKIVRSDEKDEGVNSKNVIPCTGKITTALKQDWGLNDVWNELILPRFERMNQLTQTQLFTSYNDRFQKNLPTVPIEYSQGFQKKRIDHRHHAMDALVIACATREHINYMNNQHALDKNKDKKEKQQSRIDLRTILCEKKNNNWQFKKPWSTFTQETKEALEHIVVSFKQNLRVINKATNYYEKWEEKNGVLVKKKVKQEGTNWAIRKPLHKETVSGKIVLDRKIGKDKILTATRKEVDITFTEKIISSITDTGIQKILLNYLNYKGSPEVAFSAEGLEELNKNIAQYNDGKKHQPIYKVRIFEEGSKFPLGETGAKATKFVEAAKGTNLFFGVYQGKEKRSYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 917 - protein, 1437 aa, Unknown
  Capnocytophaga sp. CM59
MKYIKYILGLDIGSNSIGWALIQLDLLQKTKRIIATGSRIIPMDQKVLSDFGKGITISPTAQRTSYRNARHCRERHLLRRERLHRVLHILGFLPTHYDKQIDFSKRYGKFVDNTEPKIAYNERKFLFMDSFQEMLADFKIHQPDLFYTKKNGEESKIPYDWTIYYLRKKALSRKISKEELAWIILNFNQKRGYYQLREEEEENKENDFEIISSKIISVIKKDKDKKYNKYWYDIILENGLVYQAAFYNDFVYNWINQDREFIIERISLKNGTEKVKLSYLPTFDEIDKMDKKEQDKYYKKIKIKTENSIGNKTVGCYIYDHILQNPNEKIKGKLVRTIERKYYKEELKAILEKQVALQPELFTDQLFADCIRELYSKNEAQQRNLAARDFVHLFVEDIIFYQRSLRRQKSTLANCSLESRSYIDKDSHTRKEAPLKVCPKSNPYYQEFRVLQWLQNLKIYEIDTDQEVTHEFIKTLEDKQQFFDFLMNQKEIDCEELLKYFLNQTYPNAREKALKSELKKWKDTYRWNYVYDIGEKSSKKYPMNETRYELKRHLEKVANLPDDFLSSEVEYLLWHLIYSVKDKVAYEKGLKTFAQKHHLDKDSFVESFKKFKPYPSEYGSFSEKAIRKLLPLMRFGSYWDFNHIDKNTQKRIEDLITGVENEEIRTILREKAEKYQLEKETDFQDLPLWLAQYIVYNRHAEASSLEKWTSVNDLETYLNEFKQYSLRNPIVEQVVMETLRVVRDIWQQYGQGQASFFDEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSTENKTIKIFTEEQYRTFIKEHYSNNPEKTKKLLLEEIPEKMVARQMNDTCYISKFISEILSKIVRSDEQDEGVHSKNVILCTGKITSALKQDWGVNDVWNDLILPRFERMNDLTQSTLFTTYNEKYQKYLPTVPMEYSNGFQKKRIDHRHHAMDAIIIACATREHINYINNQHALEKGKDKKEKQKEHDKLREKLCIKKDNKGSEENYSWIFKKPWDTFTQEVQAALEGIVVSFKQNLRVINKATNYYERWVEENGKYIKKMVKQEGTNWAIRKPLHEETISGKIYLDREEITKNDILTATRKTVDSSFDEKRIKKITDTGIQKILLNYLKYKGSPEIAFSPEGLEELNKNLSIYNDGKPHKPIYKVRIYEKGSGRFALGEKGRKYKKYVQGAPNLYFGIYQGANKRSFATIPLNEVIERQKQGRPSIPEYNEKGDPLLFSLSPNDLVYVPVEGEIIEDIDFQNLSKEQKERIYNVNDFSSTCYFTPNRIAKAIFPKEVDLQRKGDKLPGSYDTKTASLEGIQIKEVCIKLKIDRLGNISKA

SEQ ID NO: 918 - protein, 1140 aa, Catellicoccus marimammalium
MKNMTKVNVGLDVGISSAGWSVINAETNQILESGVRLFSGSDADENVNRRNQRQGRRLFRRRKLRIQEAKKYLENVFQLKDIEPKDEWNPYEIRVRALNEKVSKEELSIALLNIVKHRGISYELEDVTDEEGTNTQSFQSGLDYNRRLLKTKTVGEIQYDRLQKYGQVRGQIQTEDGLLINIFPTKNYVEEVERILETQKKYHPEIDDVFIEKIISFVTRKREYFVGPGNEKSRTDYGIYRENGETLDNLFEILIGKDKFYPEEYRAAGSSYTAQIFNLLNDLNNLRIPTTEDHHLTKAQKEEIITELKNTSRLSGGMLKLISKVTKAPKEEISGYRKDEKDKPDLHSLAYYRKQKNMLEKEGIQIADFSEELLDELATMMTLNTEPGEIRKQLNKITNQYDILTPEVIEVLVKNHTAFVATSNHKWHRFSLKLMKEFIPELLETSKEQSTILCERGFIQNRASYLDENHHFNYAELRENLYNPVVRKSTCEMLKVFTAIQEKYPNIQNVIVELPRETNEDEQKRKIKKINDNNAKRKKEILKEAQAQSGLSEEALEEKLLKTKGLYLKLMLWYEQEGKCVYSGQEIPLSDLLQNKGGYEVDHIIPISISFDDRLCNKVLVRQQLNSQKSNQTPFEYMTTHTDGHLSFHELKELVGKNKRFSKEKRELLLAEIYSNDIETRKRFINRNLVDTSYTARIVLNALQQYKKENQLSMNVSVVRGAMTNILRKKVKLDKTRETFHHHAIDASLMAVIPNIEFFKERKEWLPKSANEEVVEVEVSEEETMPEKEFKVKMRLPESFIQDVQILQRNSFAKEEVSGPQTRERNLKIKFSHQVDQKMNRKVADDTIYGTRQAQLGKDKKEETYVIGKIKDIYNYDEYVRFKKRYDKNKESFLMYHHDPQTFEKLEEILAQYPEYIEDEKGKKKKVSPFALYREENGPVTKYAKKNNGPVIKQLKYYDSKLNRKIDISHKYSTKNRQVVLQSLKPYRTDVYRNQDTGEYTLVGIDQNDGKFVNGHYGIPKSRYEEIKANNKLSEHDEFVFSLYKNSMVKVIDENGESIVVRYLSRSMPNRKNNAEIKPVEKYQFEDGEVVPVYGKCRKQMQTVFVKKGWTLLKGNTDILGNTYFVEKESENPKKMIDDK

SEQ ID NO: 919 - protein, 1419 aa, Unknown
  Chryseobacterium sp. CF314
MMIKNILGLDLGTNSIGWALIKQNFENKYGEILGMGSRIIPMSQDVLGEFGKGNSVSQTAARTGYRGVRRLRERFLLRRERLHRVLNVLNFLPEHYASQIDFEKRFGKFKYETEPKLAYNNDGFFFKNSFDEMLGDFKDHQFHLLENGRKVPYDWTIYYLRKKALSQKIEKEELAWILLNFNQKRGYYQLRGEDFEEEKDRVFVRLKVDRVVDSGENIKGKILYDVYFENGWKYEKQIVKTEDWIGRTKEFIVTESILKNGDTKRTFKAVDSEKDWIAIKTKTEQEIDKSHKTVGAYIYEALLQNPKQKIKGKLVRTIERKFYREELKKILERQKEFHPELQSDDLYNDCIRELYRNNEAHQITLSKKDFVHLLLNDLIFYQRPLRSQKSSVSNCTLEFRKYKDENGVEHAQYLKTIPKSNPYYQEFRVWQWMFNLNIYRKDDDTNVTKEFLSSTEDYETLFEFLNNRKEVDQKALLRHFKLNEKTHRWNYVEDKKYPCNETKTMISTRLEKVENYPSDFLTREMEQNIWHIIYSVNDKIEYEKALKSFAHKNNLDENSFFEAFKKFPPFKSEYGSFSEKAIKKLLPLLRLGKYWNWESIDRKSQGRIEKIITGEFDGNIKDKVREKAIHLTAENDFQGLQLWLAQYIVYGRHSEASMIGKWNSADDLEEFLKGFKQHSLRNPIVEQVITETLRVVKDIWLKYGNGAKDFFSEIHIELGREMKQTKDERVDATKRITENENTNLRIKALLAEMMNDNSVENIRPYSPMQQEILKIYEDGILKSDIEIDDDILKISKTAQPSSSDLKRYKLWLEQRYKSPYTGQIIPLNKLFTSEYEIEHIIPQSRYFDDSFSNKIICESAVNKLKDNYIGLGFIKQFGGMIVECGFGKSVEIFKAEEYEDFVKKHYANNRSKRNKLLLEEIPEKMIDRQLNDTRHISKYISGVLSNIVRQEDGTDEGVNSKNIVPGNGKITTQLKQDWGLNDVWNELILPRFERMNQLTNSTDFTSWNKNHQKFLPTVPIEFSKGFSKKRIDHRHHAMDALVIACATKDHINLLNNQSAKSDTKRYDLKRKLMKFERVVYSHSKTGEKIEKEVPKQFLKPWDNFTVDAKNKMETIIVSFKQNLRVINKATNHYEKWIEKDGIKRKELIKQEGTNWAIRKPMHKETVSGKVDLPGIKIPKGKILTATRKSLDTSFDLKTINSITDTGIQKILKNYLEFKGSSELAFSPEGIEDMNKNIEKFNDGKPHQSINKVRIFELGSKFSVGQTGNKKDKYVEAAKGTNLFFAVYEDKNGKRSYETIPLNEVIERQKQGLDSVSFKNKEDFLLCPNDLVYVPSEDELENIYNIDFKNLTTEKTGNIYKVVSFSGNQIFFIRQDIAISIVNKAEFSTLNKMERAIDGSMIKENCIKLKIDRLGNIAKI

SEQ ID NO: 920 - protein, 1065 aa, Clostridium perfringens
MNKDINYALGLDIGITSVGWAVINLDLNRIEDLGVRIFNAAENPKDGSSLALPRRLARGRRRLLRRKAYRVERVRKLIVKNNILTKEELEGLFKNKEVIDVWEARVKGLDYKLSREEWAKILINFCKRRGFKSNRKNETKDKEAGQILSSISYNIEKMKETNSRTIGEYIYNEVKNSDDSYAPLRNKFGEYKMCVSRDVLREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEDELFSTLTYSIDKDISKTENTKFVSLKGYHEIKRAIEKGVSKKAWQDIENNRNLLNDIAYVLTLGKTDDEIEKQLRLRNVPEELFESLLDMSFSKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTAVEVLKYRLWEQQRGECAYTQSQIALERLFSPGYCEIDHIIPFSRSFDDSLSNKILVLGSENQRKGNKIPYEYFGEDSERWNSFEIWVKGSYLNYKKKANLLKKKFTEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKLPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAAPFKDGIPMNEGLVAKEGMVRIDIYEKEGKYFVVPVYRYQLAKGIVPKRAAIAGKSELKWPIMDQTYNFKFSIFKNDLIEIKYAKKDGYFGYYDGFDRHTASLVIENHDNSDRYRGIGVKTGVVEFNKYEVDVLGNYHKVNLGGN

SEQ ID NO: 921 - protein, 1099 aa, Corynebacterium accolens
MSLSYRVGIDVGTYSLGCTAIEVDDNDQPVNILSSVSLIHDSGLDPDQQKRAVTRLASSGVARRTRRLYRRRRRRMINLEKFLTSQGWETRPFEHYSDPYLPWNARVALVNGYISDDAQRGMYLSIAFRHIANHRGWRNPYWKVSSLYSPDKPSDAFEQIRKELEESTGHKIPETVTVGQLISFAQFGKDRLRGGGKKKDEKKPQEQVNQAVISARLHQIDHAREINEICRVQKIDDALRKQILDLVFAAESPKGAQIGRVGKDPLQPKLPRALKASDAFQQYRIVALAGNLRIYRDGVSTPLDRDEKLIVFNYLINLSHKEEPSWLKVAEVLNIDRGQLHGTATMTDDGERAGAAPPVHDTNRTILGCKIKPLVHWWEGANDDERAAMLKALSNSEVEDFDSPAGAQTQAFFANLDESEQEKLDSLHLPIGRAAYSEDTLMRLTSRMLDENLDLYEARLAEFDIPKDWAPPAPRIGEPVGNPAVDRVLKGVARWLEAAADEWGAPKSVVIEHVRDGFISKSKANEIDRANNARHKRNRELFKQMQENLGIDGKLRSSDLWRYQSVQRQNCQCAYCGSPITYTTCEMDHIVPRAGEGSTNTRDNLVATCHRCNLAKKNIPFAVWAAQTNIPGVSVKEALDRTRHWSEDSGMTSKDFKKFRKNVCDRLKRTVVDEPLDARSMESVAWMANELRGRVAQRFQEENTVVNVYRGELTAEARRAAGISDKLRFIDGTGKSRLDRRHHAVDAAVVAFTQNYVAETLAIRSNKKREAQLLQAAEQWKEFTGSDAEHRAAWNAWLPKMQKLAVLLQKALDEDRIAVTSNLRLRLGNGRAHEDSIGELKTIRVGDAISVTDIDRASSEALWCALTREPDFDENNGLPENPDRRIRIHGTWYDAEDDIEVFPVGAGAIKVRGGYAELSRFHHARIYKIPGKKAPVYCMLRVYNADLIRHRHEDLFSVEIKPQTMSVRQAEPKLRKALAENTAEYLGWLVTDDELVIDTSNFNTGQIAEMQSELGQVRRWRLDGFYSPSTLRLRPLQMSAEGLREDTSIGAKKIIDRPGWLPAINKLFGEGHVTVVRRDALGRARLTSNAHLPISWKAE

SEQ ID NO: 922 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVWVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPERAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRATWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 923 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMQRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSPDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLGSQLSVSDIDKASSEALWCALTREPDFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 924 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLKSATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 925 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 926 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDSFQRYRIAALISNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVRDGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKELAPELSKIIDRPGWLPAVNKLFSEGNVTVVRRDSLGRVRLESTAHLPVTWKVQ

SEQ ID NO: 927 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 928 - protein, 1084 aa, Corynebacterium diphtheriae
MKYHVGIDVGTFSVGLAAIEVDDAGMPIKTLSLVSHIHDSRLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNIQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRVTMDEEIDARSMESVAWMANELRSRVAQHFASRGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 929 - protein, 1069 aa, Corynebacterium matruchotii
MAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQVGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 930 - protein, 210 aa, Diplosphaera colitermitum
MSDILDKPIVLSLNRAWQVIGHRTVKQALVALNGGNADLPPALGLDIAYPKFDDGAWNFDRPLFLNPLPWSEWIELPVRDFDFAITTPRLRIRVPTVIVATQFAKMPVRIPRLTREAIFERDGGVCQYTGEHVGKHGGNLDHVVPRDRGGRDSFENLVWAKREINSLKANRLPHEAGLRLLRRPKAPAPLPASMTIREARHPDWRHFLTP

SEQ ID NO: 931 - protein, 1332 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 932 - protein, 921 aa, Enterococcus faecalis
MIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNRILFLEEKGFLRPRVLMKLPKYTLYEFPEGRRRLLASAKEAQKGNQMVLPEHLLTLLYHAKQCLLPNQSESLTYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 933 - protein, 1337 aa, Enterococcus faecalis; identical to SEQ ID NO: 110

SEQ ID NO: 934 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 935 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSTPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 936 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 937 - protein, 936 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETR

SEQ ID NO: 938 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 939 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENLGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 940 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 941 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGVNDVVKLLGVKKERLSGWRLDKKGKPEIHTLKGYRNWRKIFAESGIDLAMLPTETIDCLAKILTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 942 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDRLIGKDFQGELRASGLSLSAQQYNLLNDLTNLKIDGEIPLSPEQKEYILAELMTKEFTRFGVNDVAKLLGVKKERLSGWRLDKKGKPEIHTLKGYRNWRKIFAESGIDLATLPTETIDCLAKVLTLNTEHEGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANHETKVRVVNGSFTHTLRKKWGADLDKTRETHHHHAVDATLCAVTPFVKVSRYHYAVKEETGEKVMREIDFETGEIVDEMSYQEFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 943 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINVQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTPFVKVSRYHYAVKEETGEKVMREIDFETGEIVNEMSYREFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEIMPAENQFKQKPYNNGAINLNIAKYGKEGKKLRKFNTDILGKKHYLFYEKEPKNIIK

SEQ ID NO: 944 - protein, 1150 aa, Enterococcus faecalis; identical to SEQ ID NO: 178

SEQ ID NO: 945 - protein, 1150 aa, Enterococcus faecalis; identical to SEQ ID NO: 179

SEQ ID NO: 946 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 947 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 948 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 949 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 950 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 951 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 952 - protein, 892 aa, Enterococcus faecium
MTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMEQWLEDPELASMFEEIIKTLTVFEDREMIKTRLSHHKATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 953 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 954 - protein, 116 aa, Unknown
  Enterococcus sp. 7L76
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTELLSKGEIYKVTLHILKNVELVT

SEQ ID NO: 955 - protein, 1391 aa, Unknown
  Eubacterium sp. AS15
MENKQYYIGLDVGTNSVGWAVTDTSYNLLRAKGKDMWGARLFDEAKTAVERRTKRTSRRRSEREKARKAMLKELFADEINKVDPNFFIRLEESKFFLDDRSENNRQRYTLFNDAKFTDKDYYEKYKTIFHLRSALINSDEKFDVRLVFLAILNLFSHRGHFLNASLKGDGEIQGVDIFYNDLYEVCEEFEIDLPQISNIDNFEKILSQKGKSRTKILEELSEELSISKKEKIKYSLLKLICGMKIKVVDIYADEDIQEDDKKKDLGFRESDYEKSSLEVKEIIGDDHFELIERAKAVHDIGLLANIIGNSKYLCEARVEAYDNHHKDLQKIKELLKKYDIKAYTDMFRKMTDKNYSAYVGSVNSNIAKERRSVDNRKIEDLYEYIKKIALKNISDDNEDKIEILKKIETGEFLKKQLTASNGVIPNQLQSRELRAILKKAENYLPFLKEKGEKNLTVSEMIIQLFEFQIPYYVGPLDKNPKKDKNANSWAVIPSGGRILPWNFEDKVDVKGSRKEFIEKMVRKCTYLSEEHTLPKQSLLYEKFMVLNEINNIKIDGEKISVEAKQKIYNDLFMKGKKVSQKAIKQELISLNIMSKDSVLSGIDTVCNAYLSSIAKFRGVFDENVNNQSTIDMIEDIIFLKTVYSDEKRFVKEEIVEKYGDEIDKDKIKRILGFKFSNWGNISKSFLELEGADVGTGEIRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYSAIKEDSKQWVKELDAKDESYFRSKKMYLYYLQKGRCMYSGEVIELDKLMDDNLYDIDHIYPRSFVKDDSLDNLVLVKKEINNRKQNDPITPQIQASCQGFWKVLHEQGFISNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPAYKYHMDRFFERDVKSKSEVAWIGQSEGNAGTIAIVKKTMSKNSPLITKKVEEGHGSITKETIVGVKEIKFGRNKVEKADKTPKKANLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 956 - protein, 1391 aa, Unknown
  Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 957 - protein, 1142 aa, Facklamia hominis
MYSVGLDIGIASCGYSIINDVNGNIVELGTLLFKSRNSDNNEERRTNRGSRRLINRRRTRLDDGKKLLAEKGFKQDSKLKHVCPYELRVKGLHEKLTQGEIYKVVLHILKKRGISYLDESDENSSGIDGASYKDQVNLNLNLQKELTPGQIQLKRLKENGRIKSGVTFENGYQLNVFSVSAYANELNKILTKQSEYYSEIDQIWIDRFTKNGYRKEAGLVYRKRPYYDGPGNEKNNSIYGRWANFKEDGHPKENIFDQLIGLDSVDSTQVRASASTLTAQKYNLLNDLNNLTIIEDDRKFTTDEKVSIINYLMTQDITRFGPKELAKFYQLEVDQIRGWRIDNKGNPEIHSLKVYRDWKKIFNTSSIDLTSIQTWVVDELANVITLNTEIPSTLATLKIKIPDIDQQILNFVENNFYELKKKTSKNSWHSFSLKTLNILIPELLNTSEEQNTILERLNLKFDLKNKYAEKNQIPVKELLEQIYNPTVTKSVHQSIKLFNEIIEKYGKNNISYVTIEMPRDKNDQDQKDTIKRINKLNSERKNDSEKYFLERSGWDTIRFESALKKPRFAEKLLFYYEQKGKCAYSGQDILAESLLNESCEVDHIIPLSISFDDSIHNKVLVTASSNQEKGQRTPYMAFIDGAKLGQSWDDFVAWVNSCGFHRKKVQNLLYEENIFNPDVQRGFVSRNLNDTRYASRIVLNAIQSFFYKQKDLTKVKVVNGSFTHTLRKKWGSSLDKNRDTYHHHAVDATLCAVTPFINIVKYEFFEEDGIKYMVDLTTGEKVAYSDYKKMKFYDKRAYVPIWDGFIKQLTPANLYPKIKFSHQVDSKWNRKISDATIYSTRKIVETKINKKGVAKETVKDIVIDKIKDIYTPEGWRKFKEKQDKLLMKNFDEKTYNKLIKIAKEYPEKKEVQTSNGKVSLVEVSPFKMYCEEQNVPAIRKYSKKGNGPYIRSLKFYDKELGKHINITKDSYGNDIERTIRNKKIILKNQNSWRTDVYYNSVNNCYELLGIKYCHLKFYRGKYGIPKSIYDELKKEDEISSESVFKFSLYRHDRVRFEKDGEYIEALFGSKNESNKNYLELSPIDKNKWLSKENVKFFGEVAASGRFIKGLKPGIKVIKQSTDYMGHVYAIHQEKLKFVLSDA

SEQ ID NO: 958 - protein, 1347 aa, Finegoldia magna
MKSEKKYYIGLDVGTNSVGWAVTDEFYNILRAKGKDLWGVRLFEKAKTAADTRTFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEAVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRIKGKPLDTDVKLKLIEELFKKKTKVTLKSIRDYMIRNNFADKEDFDNSEKNLEIVSNMKSYIDFNNILGDKFELEMVEDLIEKITIHTGNKTLLKKYIEETYPDLSSSQIQKIINLKYKDWGRLSRKLLDGIKGRNKTDDVNTVINFMRNSSDNLMQIIEGKNYSFNEYIDNLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDESELRSKKLYLYYTQMGRDMYTGEKIDLDKLFDSTHYDKDHIIPQSMKKDDSIINNLVLVNKNANQTTKGNIYPVPSSIRNNPDIYNYWKYLMEKEFISKEKYNRLIRNTPLTNEELGVFINRQLVETRQSTKAIKELFEKFYQKSKIIPVKASLASDLRKDMNTLKSREVNDLHHAHDAFLNIVAGDVWNREFTSNPINYVNENREGDKVKYSLSKYFTRPRKSKGKVIWTPEKGRKLIVDTLNKPSVLISNESHVKKGELFNATISGKKDYKKGKIYLPLKKDDRLKDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 959 - protein, 1348 aa, Finegoldia magna; identical to SEQ ID NO: 222

SEQ ID NO: 960 - protein, 1516 aa, Unknown
  Flavobacteriaceae bacterium
MLKQQKDKIIGMNKKILGLDLGTNSIGWALVKQDLENKYGEIIGCGSRIIPMSQDVLGKFDAGISISQTAERTNYRSVRKLIQRNTLRRERLHRVLHQLDFLPKHYNDSIDFEKKLGQFKTDKETKLNYFVNQHGKHEFLFKDSFNEMVKEFKEEQPELFYIKNNGKETKIPYDWTIYYLRKKALSKKISKEELSWLVLNFNQKRGYYQLRGEIDEEKEKNKRYEKLYVSEVVKTNNTIKKTGEYLYDIYFDNGWKYEKQTTKPQDWLHKHKEFIITTTTLKNGETKRTFKTVDSEKDWIAIKSKTEQDIKESNKTVGAFIYDTLLKNPTQKIRGSLVKTIERKFYREEFEKILKEQIKHRPEINVNTAIGKENYTKCVTELYPRNEAHANNILTNDFNYLFTKDILFYQRPLKSKKSEIANCQYEYRTYIKKKEKTGKEERVKQPLKATPKSHPLFQEFRLWQFIHNLKIYIRETTVGNKPLFDVDITDTFFTSENDWATLFEYLNNKKEIEQKHVLEYLVSKKIISKSEKTDYRWNYVEDKKYPGNETRVDFINRLKKVENLNVDEFLTSELEFKLWHIIYSVTDKNEYEKALENFAIRQNIDKDSFVNSFKKFPPFKSDYGAYSTKAIKKLLPLMRLGKFWDGSEIPKVVVEKITDIKTRLTSVNYDESLFKKDEKKILETIVDDITPKQLLKSFVKLKGKNHLAGLNTYQACYLVYERHSESSDITQWENPDDIDSFLNHFKQHSLRNPIVEQVVTETLRTVRDIWKYYGNGSPNYFNEIHIELGREMKNPADKRKQMSAKINENENTNQRIKGILQELMNDGVQDIKPYSPSQQEILKIYEEGISQNPNVDYSKVSEDEITKIKKSNNPTLKEIQRYKLWLEQKYISPYTGKPIPLSELFTPAYQIEHIIPQSRYFDNSLSNKIICESEVNEDKSNKTAYEYLKTNGGSIVHGHHLLSLKEYEDHCQHYFKKNRTKLKNLLSEEIPEGFINRQLNDSRYISKLIKGLLSNIVREENEQEATSKNIVPVTGSITSKLKQDWGLNDKWNEIIAPRFKRLNKMTNSNDFGYFDEKINTFRIQVPDAISRGFNKKRIDHRHHTLDALVIACCTKKHIQYLNSLNNEIIKHELKPSILIKNAQGDYTKHFMLPWNNFPIDCKNAIENTIVSFKQNLRVINKTSNKYQSYKDENGNLRLGKDGKPKKGLTKQTKGNNWAVRKAMHEDTFYGEIVDGENKGKLKIKTLLDTSFDVKKIEDKVLDKSIRTILINYLKQDKYKNLSKPHEEAFSPNGIIEMNKNIISLNNNIPHKPIKRVTLKHEKGKKFSIKTLLDKKTKFAKSATGTNVFFCIYKNINGKIKYHTPSFEEIIEIQKQEFEIKYKSKLNVPETLFDKKESFELLFYLQPNDLVYLPNDEELKNRQLIDFNNLNKKQIKRIYKFTDGSGTTANFIPYQVAKVIFNLNKKEQAKSSFKYPIQNEFGVGSPQSKNQKSIEGILIKERCIKLKIDRLGNISKA

SEQ ID NO: 961 - protein, 1629 aa, Unknown
  Francisella cf. novicida Fx1
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINIQILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYRSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAITTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLANNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNITIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 962 - protein, 1646 aa, Unknown
  Francisella cf. novicida 3523
MNIKILPIAIDLGAKNTGVFSAFYQKGTSLESLDNKNGKVYELSKDSYTLLMNNRTARRHQRRGIDRKQLVKRLFKLIWTKQLNLEWNKDTQQTISFLLNRRGFSFITDGYSPEYLNIAPEAVKAILMSILDDYNGEDDLDSYLQSATENDSKIDELYNKLLQKALEFKLRKLCIDIKEDKVTTKTLKELSNTEFKLLANYLVDYDRILRTQKFSYTDKQGNLRELNYYHHDKYNIQEFLKRNIIINDVILEKLTDDLDIWNLNFDKFDFEKNLEKLENQEDKDYLQTHLHHFVFAVNKIKSEMASGGRHRSQYFQEITNVLVENNHQEGYLKNFCENLHNKKYSNLSVKNLVNLIGNLSNLELKPLRKYFNDKIHAKADYWDEQKFAETYSDWILGEWRVGAKDKDKKDGAKYSYKNLCDELKQKVGINQDGIINQTKSDFVDFLLELDPCRTIPPYLDNNNRKPPKCQSLILNPKFLDNKYPNWQQYLQELKKLQTVQNYLGNFEIDLKDLKSSKEQPYFVKYKSLNQQIASGQRDYKDLDARVLQFIFDRVKASDELLLNEIYSHAKKLKQNTSSELEKLELCKKLDEVIANSQLSQILKSQHVNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNQASKLEFDRKIKKFNSIYSFAQIQQIAFAERKGNANTCAVCSADNAHRMQQIKVAKPVEGNKDNIILSAKAQRLPAIPTRIVDGAVKKIATILARNIVDDNWDNIKQALSNNQQLHVPIITESNAFEFEPALADIKGKSLKDKRKKALERIDPENVFKDKNNRIKEFAKGISAYSDANLANGDFDGAKEELDHIIPRSHKKYGTLNDEANLICVTREDNQNRGNKAVFLYDLKPNYKLKQFNTTDDLEIEKKIADTIWDASKQDFKFGNYRSFINLTPQEQIAFRHALFLADKNPIKKAVIRAIDNRNRTFVNGTQRYFAEVLANNIYLRAKKENLATNRITFDYFGIETTNSNGRGIADVRKLYEKVDSDIQAYAKGDKPQDSYSHLIDAMIAFCVAADEHKNEGSIGLKMGNQYGLFPTPDKYDENTGEIISWHNDDIFRKIKVSDNQFSDKKLVRKKATEGFNTHRQMTRDGIYGESYLPILIHKNLNEVRKGYNWENSEEIKIFKGKKYDIQQLNNLVYCLKFVDKPISIDIQITTLEELRNILETNNISTTAEYYYINLKTQKLHEYYIENYNTALGYKKYTKEMEFLRSLAYRTERVKIKSIDDVSMILAKDSNFKAGKIELPFKTEWQRLYLEWQNTTIKDNHEFLKSYFSVKNATKQHKKVRKDFSLPISTNEGKLLVKRKTWDNNFIYQILNDSDSRADGTKPFIPAFDISKNEIVETIIKSFTSKNIFWLPKNIELQKVDNKSIFAIDTSRWFEVETPKDLIEIGVSTIQYKIDNNSRPKVRVKLDYVMDDDSKINYFMNHSLLKSRYPDKVLEILKQSTIIEFESSGFNKTIKEMLGMTLAGIYNETSNN

SEQ ID NO: 963 - protein, 1629 aa, Francisella novicida
MNFKILPIAIDLGVKNTGVFSAFYQKGTSLERLDNKNGKVYELSKDSYTLLMNNRTARRHQRRGIDRKQLVKKLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGLKDQDKKEGAKYSYKDLCNELKQKVTNAGLIDFLLELDPCRTIPPYLDNNNRKPPKCQSLILNPKFLDNQYPNWQQYLQELKKLQIIQDYLESFETDLKVLKSSKDQPYFVEYKSSNQQIASGQRDYKDLDARILQFIFDRVKASDELLLNEIYFQAKKLKQKASSELEKLESSKKLDEVIANSQLSKILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQVYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 964 - protein, 1629 aa, Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTTIEFESSGFNKTIKEMLGMTLAGIYNETSNN

SEQ ID NO: 965 - protein, 244 aa, Francisella tularensis
ARKQNSEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQNQEDKDHTQAYLHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 966 - protein, 501 aa, Francisella tularensis
MEIEKKIADTIWDASKQDFKFGNYRSFINLTPQEQKAFRYALFLADENSIKQAVIRAINNRNRTFVNGTQRYFAEVLANNIYLRAKKENLNTDKISFDYFGIPTIGNGRGIADIRQLYEKVDSDIQAYAKGDKPQASYSHLIDAMIAFCVAADEHRNDGSIGLEIDKNYSLYLLDKNTGEVFTKDIFSQIKITDNEFSDKKLVRKKATEGFNTHRQMTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQNVDKIFLL

SEQ ID NO: 967 - protein, 158 aa, Francisella tularensis
MIDFLLELDPCITIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLS

SEQ ID NO: 968 - protein, 878 aa, Francisella tularensis
MLNDLAGVLQVSRNQLLSSVEEWFQQAQRVGEISKSQDEQIFEWLKSFKIASYCKAAVEMQKQYRGTLKNAIQTAIFRQSENINKNKNKNKNTGNQQQALSENSKDVKSLTADEKKLLKLIENIAKASQKIGESLGLNDKQIKKFNSIYNFAQIQQIAFAERKGNANTCAVYSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSYKKYGTLNDEVNLICVTRDDNKNKGKRIFCLNDLANNYKLKQFETTDDLEIEKKIADTIWDASKQDFKFGNYRSFINLIPQEQKAFRYALFLADENSIKQAVIRAINNRNRTFVNGTQRYFAEVLANNIYLRAKKENLNTDKISFDYFGIPTIGNGRGIADIRQLYEKVDSDIQAYAKGDKPQASYSHLIDAMIAFCVAADEHRNDGSIGLEIDKNYSLYPLDKNTGEVFTKDIFSQIKITDNEFSDKKLVRKKATEGFNTHRQMTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSINKLHKKVRKDFSLPISTNEGKFLVKRKTWDNNFIYQILNDSDSRVDGTKPFIPAFDISKNEIVEAIIDSFTSKNIFWLPKNIELQKVDKIFLL

SEQ ID NO: 969 - protein, 292 aa, Francisella tularensis
MLNDLAGVLQVSRNQLLSSVEEWFQQAQRVGEISKSQDEQIFEWLKSFKIASYCKAAVEMQKQYRGTLKNAIQTAIFRQSENINKNKNKNTGNQQQALSENSKDVKSLTADEKKLLKLIENIAKASQKIGESLGLNDKQIKKFNSIYNFAQIQQIAFAERKGNANTCAVYSADNAHRMQQIKITELVEDNKDNIILSAKAQRLPAIPTRIVDGAVKKMVTILAKNIVDDNWQNIKQVLSAKHQLHIPIITESNAFEFEPALADVKGKSLKDRRKKALERISPENIFKDKNIC

SEQ ID NO: 970 - protein, 53 aa, Francisella tularensis
MNHSLLKSRYPDKVLEILKQSTIIEFESSGFNKTIKEMLGMTLAGIYNETSNN

SEQ ID NO: 971 - protein, 393 aa, Francisella tularensis
MNVKILPIAIDLDVKNTGVFSAFYQKGTSLEKLDNKNGKVYELSKDSYTLLMNNRTAQRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQNQEDKDHTQAYLHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 972 - protein, 1629 aa, Francisella tularensis
MNVKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSIKDRRKKALERISPENIFKDKNNRIKEFAKGISAYSGDNLASGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIVEIRQLYEKVDSDIQAYAKGDKPQASYSHLIDAMLAFCIAADEHRNDGSIGLEIDKNYSLYPLDKNTGEVFTKDIFSQIKITNNEFSDKKLVRKKATEGFNTHRQMTRDGIYAENYLPILIHKELDEVRKGYTWGNSEELKIHKGKKYDIQQLNNLVYCLKFIDKSISIDIQISTLEELRNILTTNNIATTAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 973 - protein, 285 aa, Francisella tularensis
MTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDKIFLL

SEQ ID NO: 974 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 975 - protein, 1367 aa, Unknown
  Fusobacterium sp. 3_1_36A2
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 976 - protein, 1367 aa, Unknown
  Fusobacterium sp. 3_1_27
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKIIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 977 - protein, 1367 aa, Unknown
  Fusobacterium sp. 1_1_41FAA
MKKQQFSDYYLGFDIGTNSVGWCVTDFNYNVLRFNKKDMWGSRLFDEAKTAAERRVQRNSRRRLKRRKWRLNLLEEIFSDEILKIDSNFFRRLKESSLWLEDKSSKEKFTLFNDDNYKDYDFYKQYPTIFHLRNELIKNPEKKDIRLVYLALHSIFKSRGHFLFEGQNLKDIKNFETLYNNLMAFLEDNDIYKNIDSSYIGNLENIICDSKKGLKDKEKEFKEIFNSDKQLVGFFKLSVGSSVSLNDLFDTDEYKKGEVEKEKISFREQIYEDDKPIYYSILGEKIEFLDIAKSFYDFMVLNNILADSQYISEAKVKLYDEHKRDLKNLKYIIRKYNKENYDKLFKDKNESNYSAYIGLNKEKGKKEVIEKSRLKIDDFAKIIKGYLPKAEKIDEKDRSIFNEILDKIELKTILPKQRISDNGTLPYQIHEAELEKILENQAKYYDFLNHEENGISTKDKLLMTFKFRIPYYVGPLNSYHKNKGGNSWIVRKEEGKILPWNFEQKVDIEKSAEEFIKRMTNKCTYLNGEDVIPKDSFLYSEYIILNELNKVQVNDEFLNKEIKKKIIEDLFKKSKKISEKNFREYLLVNQITNKTVELKGVKDAFNSNYVSYIKFKDIFGDKLNLDIYKEISEKSILWKCLYGDDKKIFEKKIKSVYGDILTKDEIKKINSFKFNTWGRLSEKLLTEIEFIDLETGECYSSVMDALRRTNYNLMELLSSKFTLQENIDNENKEVSEFSYRDLVEESYVSPSLKRAILQTLKIYEEIRKITGRIPKKVFIEMARGGDETMKNKKIPARQEQLKKLYDSCGKDISNFSIDIKEMKNSLNSYDNNSLRQKKLYLYYLQFGKCMYTGKEIDLNRLLQNNDTYDIDHIYPRSKVIKDDSFDNLVLVLKNENAEKSNEYPLKKEIQEKMKSFWKFLKEKNFISDEKYKRLTGKDEFELRGFMARQLVNVRQTTKEAGKILQQIEPEIKIVYSKAEIASSFREMFDFIKVRELNDTHHAKDAYLNIVAGNVYNTKFTEKPYRYLQEIKENYDVKKIYNYDIKNAWDKEKSLEIVKKNMEKNTVNITRFIKEEKGQLFDLNPIRKGETSNEIIAIKPKFYEGSTEKLNEKYGYYKSLNPAYFIYVEHKEKNKIIRSFERVNLVDVNKIKDEKSLIKYLIENKGLIEPKVIKKVYKRQVILINNFPYSIVALDSNKLMDFENLKPLFLERKYEKILKNAIKFLEDNQGKTEEYYKFLYLKKKDRNEKNETIDSVKERYNIEFNEMYDKFLEKLDSKDYKNYINNKKYSELVNVKEKFIKLNLFDKAFTLKSFLDLFNRKTMADFSKVGLTKYLGKIQKISSNVLSKNELHLLEESVTGLFVKKIKL

SEQ ID NO: 978 - protein, 1391 aa, Unknown
  Galbibacter sp. ck-I2-15
MKTILGLDLGTNSIGWALVKEAENENEVSDIIKLGVRVNPLTVDELTNFEGGKAYSNNAERTLKRGARRNLQRYKLRRENLIEILLKNGLINKDTALTEVGKETTHQTLKLRSKSANEKVSLEDLAKILLSINKKRGYKSSRKVNAEDDGVAIDGMEVAKLLYDENMTPGEYVLRLLESGKKHLPDFYRSDLQEEFNLVWKKQSEFYPLILTKELFFELHGKNKSQTWAICKEPLGIVGVKLKGSAKEQKFARYRLRKEALTQQIELEHLAIVLQDINNDSNKSSGYLGAISDRSKELFFNKETVGQYQYKQLQKDPNTSLKNQVFYRQDYLDEFEVIWRNQAKFYPQLTNELKQEIRDVVIFYQRKLKSQKNLISFCQFESTQQNYVEKETGKTKIRTIGRRVIPRSSPLFQEFKIWQSLNNLKFVNSESNQIIQFIELEDDVKKVVFDELNLRGDLKPNQVLKILSKYMKIGKLTQWKCNLEEIEGNRTNSALYNVFQMIAEEEGYGFNWGKKSALEIKSELKAIFSSIGINDSILDFDFSKKLDQQLSYQLWHLLYSAEEGNSKITEEDKFTYGNTGVALKKKLHLKFGFKPEYSTLISNLRFTSDYGNLSSKAISKILPFLRDGSDYSKACQYAGYNHSNSLSADELDNRELKPKLELLKKNSLRNPVVEKILNQMVNVVNQVIDNYGKPDEVRIELARELKKSAKERSQMTKNISDATRRNAEIKKYLSKEFGIPNPTKGDVIRYRLWEELASNGYKDLFRDKYIPKEKLFSNEIDIEHIIPKALLFDDSFSNKTLAFKVDNLKKADRTAFDFMSTDFSKDVDSYIGRIETLHKDGKISSSKYKKLMIPKSKLVDGFIERDLRNTQYIAKQARKMLLEVFKTVVPTTGKITDKLREDWDLINVMKELNFPKYKALGLTKKIERFDVGSEKIKSINVIEGWSKRNDHRHHAMDALAVAFTTHNHIQYLNYLNARKDIHHEMHGTIKSIENQIIGKDVMGKRRFIPPISDLRMKAKLQIESILISFKNKNKVVTWSVNKTKLKGKDNYNKRRQLTPRGQLHKETVYGKIKLIDPKPLKLNNKFTLVRASMIVDKVHREIVLQHLSKYDNNSEVAFDSKTIKIDPILIEGIGLKEVVCYEDVFKIRKKISGDNFKNEKHLEKVIDEKVKQILKDRVIKFQGNFKEAFSNLEENPIWLNKSKGIAVKSVAIKGVNNAESLHEGKDHFGDQILDKNKKQIPVDFVSTGNNHHVGIYEDKDGNLQERVVSFFEAVTRVNEGLPIIDKTYNSDIGWKFKFTMKQNEMFVFPSDDFDPNEFDLTDGKNAAKISPNLYRVQKIATKNYMFRHHLETVVTNDLEFTYKSIRSTGWLRNLVKVRINHLGEIVYVGEY

SEQ ID NO: 979 - protein, 1186 aa, Gardnerella vaginalis
MEGNISYAIGIDVGLNSVGLAAIRLDDYGEPIRILKAMSVIHDAGIDPNGAKESDTRKAISGVARRVRRLYRQRRRRLQKLDFLLQSLGWPVVENKDLDFSDSFIPWIFRAKLADEYIADEEQRKQMLSVAIRHIARHRGWRNPYQSIKSMMQETEYSEFYNELLKNIEKLAPGVGCEGSTPAQLVRDYLLSQQGKASRRLRITTGGRRKNHPHSLDPVLPRKLMQSDNMLEILNIFNVQHIDDKYVREQIINAVFYAESPRGSAENRVGKDAITGKGKRALKASLAFQKYRIISTISNLRIRENSKERCLTIEEKQNVYKLLTTSIDKSSKRKSAEAPLYTWIDVADCLGIERYKLRGVGSQIGDGESVGNRPPMLNSELAILYANNKSLGQSLITWWLASNRTQEDKEALIEILSNTVDIEAIHDNPEYQDKYGSAIAFIDSMNETEIAALENISLPDGRAAYSLETLDELNKQMLETDDDLFEARKKLFNLPNNWRPAEAPIAEPTGNPSVDRVLKIVHRFLISAKNRWGNPERINIEHVRSGFQSKKMANSYKELLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEQSTYCKNHDISADSAINRVRAFIFPPNSYDKRGANQFKKEVIARLKQKVGDEAFDNRSIESVAWMANELHRRIDWYYNSQNYQTNNGISDISNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYSNSSVHQYEVNALLKLHVGDEIDSETIRRSSTPALYCALTRNPDYDVNNGFPENPGRTILLHNKKLNADDSITFFKAQAVQLFVREGSAKIGNSIHHLRIYEYFEKLKSGKIKKSYGMIRVFQNDLHRHIHEDLFSCDLPEQSISMRYADTKVAHAVQTGNANYLGYLVPGDEIIVDFSHITLSENIGKFVEFLNKIGADCTAYRHWVVVGTDTEKVLILKPSMISSEGIDKLYSNCERNNFDYSSYEKSINEILAGKGWRVSVNVLAQYKAATIRRNALGEVRWASRSHLPISWSWDTGENRE

SEQ ID NO: 980 - protein, 1186 aa, Gardnerella vaginalis
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFIPWIFRAKLADEYIADEKQRKQMLSVAIRHIARHRGWRNPYQSIKSMTQETEYSEFYNELLKNIEKFAPGVGCEGSTPAQLVRDYLLLQQGKASRRLRITTDEKRKNHPNSLNPILPRKLMQSDNMLEILNIFNVQHIDDKYVREQIINAVFYAKSPRGSAENRVGKDAITGKGKRALKASLAFQKYRIISTISNLRIRENSKERCLTIEEKQSVYKLLTTSTDESSKEKSAEAPLYTWIDVADCLGIERYKLRGVGSQIGDGESVGNRPPMLNSELAIIYANNKSLGKSLLTWWLDANRTQEDKEALIEILSNTVDIEAIHDNPEYQDKYGSAIAFIDSMDETEIAALENISLPDGRAAYSLETLDKLNKQMLETDDDLFEARKKLFNLPNNWRPSEAPIAEPTGNPSVDRVLKIVHRFLISAKNRWGNPERINIEHVRSGFKSKKMANSYKELLDKRTKGKENLKAMMRNSLHLGMSDSISDADIRRYEAVQRQNGQCLYCGSEITYHTCELDHIVPRKGPGSTNTRENLVATCSLCNAQKCNTPFSTWCEQSTYCKNHDISVDSAINRVRAFIFPPNSYDKRGANQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYNNSSVHQYKVNALLKLHVGDEIDSGTIRRSSTPALYCALTRNPDYDVNNGLPENPNRAILLHDKKLNADDSITFFKAQAVQLFVREGSAEIGSSTHHLRIYEYFKKLKSGKIKKSYGMIRVFQNDLHRHIHEDLFSCDLPEQSISMRYADTEVAHAVQTGNSNYLGYLVPGDEIIVDFSHVKLSGNIGTFVEFLNKIGANCAAYNHWVVVGTDTEKVLILKPSMISSEGIDKLYSNCKRNNFDYSSYEKSINEILVGKGWRVSVNVLAKYNAETIRRNALGEVRWTSRSHLPISWSWNTGENRE

SEQ ID NO: 981 - protein, 1258 aa, Gemella haemolysans
MTEENPDIRKVFLAIHHILKNRGHFLLQGQSFKEGNLNNLIKELLNLDILHISIEITEENINKITEIALEKKTLTDKVNDLKKIYPKEKQLLEAFRLIFGGKTSLDKLFAIDEYKELDASVKSVSFKEKIYEEVRHDYEQVLSNYIELLDLAKLVYDSIILSDIKKEGKTLSESKVELYHKHREDLTKLKTLVKNDSKLSEDKKVELYSAIFKEDKDKGTNYVNYIRKSEEGKGCNYEDFKKFLVKELAKLEESSAKEEILRDLELELFLPLQRTKDNSVVPYQIHKEELVKILDNAAKYHKFLNEKDDSGYSIIEKVIQLLEFRIPYYVGPLNSSKKAKVDGFAWSVRNKGYENTPVTPWNYEKVIDESASAEKFITNLTNKCTYLKGEDVLPKSSLLYSEFALLNELNALKYDGNRISLEARNVIIEKLFKEQGKKVTKTSIKNLLKAEGYIDGKGEITGIDITVKNDLKSYRDFKKILGDKFNTEHVENIILWITLYGESRKLIKAKIEAVYGDIYSKEEIAKMSRLVYKDWGRFSRKLLTELVSKKLYNEETGECLNIIGAMRQNNILFMELLADRFDYSQQIIDYNKELQKEVTEITPEILDDLYVSPSVKRSIWQTVRIVEELKKIIGCAPAKIFVETTRSNQDKKKPTDSRKKQLELFYKAVKKDVKDLEKEIGSLNFDKLNERLSSVEPSKLKAKKLYLYYTQLGRCMYSGETIDITQLNTTAYDIDHIYPQSKVKDDSFTNTVLVKREYNAAKTDRYPLGSDIQTPSNRRFWKFLKEKGLITDEKYNRLVRTEEFSDEELTGFIARQLVETSQSVKAVAGILGELNPKTSICYSKAENVSSFRQNFGKIKEGNRKSDNTEQLIKVREINDYHHAKDAYLNVVVGNVYDTKFTRNVFNFIKDKKDGRKYSLNNVFYENVSNSNNVAWELNKTVHQVEKVMNNNNILVTRRTSEQKGGLFDATVYKAKVAAKAKEGVYYPLKTSDPVVNDVTKYGGFTKVKIAYYSIFEYTLVNKKGEEKITRIIPIPIYVSQNIKDDSTLLEFGKTQINIKSGEEVKDFKLKYRKLCIGDLVKINNFFNFIGGKTNDSFVYDGAVQVTLDTESERYIKTLSKYQNWKKENKDGELWESITKEKNTELYNLLVEKMNSGIFIKKKPNKFNELNSEEIRNNFSSISLEEQAKVLLEVLNLLTNKKSIFDLKSINITAARGKISFNLSNLSQFSIIEQSVAGFYEKEITIIGDKENDMENNNC

SEQ ID NO: 982 - protein, 1054 aa, Haemophilus parainfluenzae
MENKNLNYILGLDLGIASVGWAVVEIDEKENPLRLIDVGVRTFERAEVPKTGESLALSRRLARSARRLTQRRVARLKKAKRLLKSENILLSTDERLPHQVWQLRVEGLDHKLERQEWAAVLLHLIKHRGYLSQRKNESKSENKELGALLSGVDNNHKLLQQATYRSPAELAVKKFEVEEGHIRNQQGAYTHTFSRLDLLAEMELLFSRQQHFGNPFASEKLLENLTALLMWQKPALSGEAILKMLGKCTFEDEYKAAKNTYSAERFVWITKLNNLRIQENGLERALNDNERLALMEQPYDKNRLFYSQVRSILKLSDEAIFKGLRYSGEDKKAIETKAVLMEMKAYHQIRKVLEGNNLKAEWAELKANPTLLDEIGTAFSLYKTDEDISAYLAGKLSQPVLNALLENLSFDKFIQLSLKALYKLLPLMQQGLRYDEACREIYGDHYGKKTEENHHFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKKQRILSQKLDEKGFIERNLNDTRYVARFLCNFIADNMHLTGEGKRKVFASNGQITALLRSRWGLAKSREDNDRHHALDAVVVACSTVAMQQKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLKLKDLELMVNREREKDLYDTLKARLEAFNDDPAKAFAEPFIKKGGAIVKSVRVEQIQKSGVLVREGNGVADNASMVRVDVFTKGGKYFLVPIYTWQVAKGILPNKAATQYKDEEDWEVMDNSATFKFSLHPNDLVKLVTKKKTILGYFNGLNRATGNIDIKEHDLDKSKGKQGIFEGVGIKLALSFEKYQVDELGKNIRLCKPSKRQPVR

SEQ ID NO: 983 - protein, 1052 aa, Haemophilus parainfluenzae]
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMIGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 984 - protein, 121 aa, Haemophilus pittmaniae
MLNRRYAAKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLN

SEQ ID NO: 985 - protein, 203 aa, Haemophilus pittmaniae
MVNREREKDLYDALKARLEAFNDDPAKAFAEPFIKKGGAIVKSVRVEQVQKSGVLVREGNGVADNASMVRVDVFTKDGKYFLVPIYTWQVAKGILPNKAATQYKDEEDWEVMDNSAIFKFSLHPNDLVKLVTKKKTILGYFNGLDRATGNIAIKEHDLEKSKAKGGIHQGVGIKLALSFEKYQIDELGKNIRLCNPSKCQSVR

SEQ ID NO: 986 - protein, 1052 aa, Haemophilus sputorum
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMTGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 987 - protein, 1338 aa, Helcococcus kunzii
MQDYYLGLDIGTNSVGWAVTDENYNLLRKKGKDLWGVRLFKEAQPATERRGHRSSRRRTIRKSLRKQLLRELFEEEINAIDKDFFLRLDESKYWLEDKKIEGKYSLFNDENFTDKDYYEKFPTIFHLRKALIESDDKEDIRLYFLAINQMMKRRGHFLIDGKLSNVEDITPFKECIQNLINEELDTEIETEFYDKAIKIVSDYSLKKTEKKNLIKDLVKETDSIEDSKKIINIFNLLISGKSKVNGIFDDEEILEKIKEDNKEDFYLTSEKYEENLEYFSQLLDYRFELISSLKSIYDYIILQEVLKGKKYLSYAQVERYKNHKEDLRKLKQLIKKYDKNGKIYYQIFRDENFKKGYVAYLGYYKKNKKNVPVKKCDYDTFSKNIKSTLDKICDKEDPLYIELIDKIEKGGFLLKQIVSTNSVIPHQVHELELDKILENLEKNYPSFKEISDGVSKIDKIKMIFNFRIPYYVGPLNDYHKDKVNSNTWIVKNEGFENENIRPWNFSKIVDEHACEEEFIKRMINECSYIPGEKVLPKSSLLYSEYMVLNELNNLRVNGDKLNPKIKKEIVENIYKKERKVTLKKIRNFLIINNYVDSKVEFSGLSDGIKANMSSYIDFAEILDDNFDNNMVEDLIEQITIHVGNVKLLTEKISNKYPNLEKKQINKIVNLKFKDWARFSRKLLVGIEGTEKETGEINTIIGFLRETNENFMELMSNRYTFSEEISEIKKKYIPNKLSKQIVDDLYVSPAVKKMIWQVLNINDELIKVLGKQPKKIFIEMARGKEEKPEVKDSRKNKLIELYKNLGKEGKEWLNRIEDKTEADFRNRALYLYYTQMGRCMYTGEIIDIERLYDKELYDLDHIIPRKMKKDDSIHKNLVLVTRNSNQYEKKDNYPVPEVIKSRENVRHLWYALKKKGLITEEKYNRLTRINPLSDKELSEFIERQLVETRQTTKVVKDLFENYYTDSKIVTVKAGLVSELRRDFEVLKCREINDLNHAHDAFLNIIVGDVWSKKFTSNPYNFVKKNREKYTLNNIFTKNQKDLRGNEIWNCAEGKKRIIKTLNKPSVLFSVENFEQTGQLFDQNIIGKQDYKEKTSYVPIKGDERLQDISKYGGYRGISGAYFFIVEHTEKNKRVKTIESLPIYMKSYVEENGLLDFCTNEMKLVDPKIIVKKLNYKSEIIVDGFKYLISGKTENRLSLETNEYLYWNHTQTTDIKKILNINEKIELEKYNGDIESERENIIKYIQIILEKFKLKPFIKRRNLPNIEINFADYETEKLLQLLVNLIPLTTKYVSPVDLTVISGSKYAGKVLIPKKISNLNEVIFISKSITGIYESRRRII

SEQ ID NO: 988 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRTPKDSLSAIEFIALSRTINTLINLSKESGEIYNRAIILQIVESTLKKGEISYKELREIIRLDERLRFKDPRLDYSREIKEAEKVKFLEFKQLKGFKKALGESFTTLARSQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNALLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLGKGQKGSKKHIAIVNGALTSTMRYYLGFASKDRDNHLHHALDAVIIGFMNDSVIKAFSDFKKTQETSKAAYYAHTLSKQEYKKQRAFIQLPSGENFRASVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDKNGVIKDWLEMDSSYEFIFSLYKDDLLLVQKKEMAEPELCYFMSFNSSIAQISVAKHDNNFSTLTKNQKLLFSNATQEDVSGKSIGIQNLQVFEKWQVSVLGEVKRTQSYPRENISLASKAKK

SEQ ID NO: 989 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFESKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 990 - protein, 344 aa, Helicobacter pullorum
MKILGFDIGIASIGWAFVENGELKDCGVRIFTKAENPKTGDSLAMPRREARSVRRRLARRKGRLETLKRLLAKEWDLCYEDYIAADGELPKAFMGKNLTNPYVLRYEALQRLLSKEELVRVVLHIAKHRGYGNKNAKITKSEESKREQGKILSALATNASVIARYRTVGEYFYKEFCEVIKNPQGLNTNENCTQPKVRVLKPIRNKGGEYTNCILQEDLQRELRCIFEHQKGFGFSITQEFQDKILKIAFYQRSLKDFSHLVGKCTFYPDEPRAPKFSLSAIEFITKAKAINLLASIAKESGEVWDKEQWRERLDSVFSAVCERGINTIPSSSHFLNIFDILYL

SEQ ID NO: 991 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 992 - protein, 1354 aa, Indibacter alkaliphilus
MKKILGLDLGTTSIGWAFIKEPEKDVVGSEIVDMGVRIVPLSSDEENDFAKGNTISINADRTLKRGARRNLQRFKQRRNALLETFKEKNLIPSNFQYAEDGPSSTFSTLKLRDKAAKEKIELDDFVKVLLQINKKRGYKSSRKAMSEEDEGTAIDSMGIAKELYENDLTPGQWVYEALKNGRKNVPDFYRSDLQEEFKKIVNYQSEFYPDILNTSFVEDWMGKASTPTKQYFNKRGVQLAENKGKREERRLQEYKWRAEAVNFKIDLSEIALILSQINSQISNSSGYLGAISDRSKELYFKNLTVGQYLYQQVKKNPHTRLKGQVFYRQDYLDEFEKIWSVQSSFYPQLNDELKQEVRDVTIFFQRRLKSQKHLISNCEFEEHHKVVPKSHPIFQEFRIWQNLNNLTLIKKDNLNEKCELALEDKTALANELAFKKELSVKDALKVLGLKPSDWEFNFTKIEGNRTNHAFFEAFAKIIELEDGEPIDLGNLKADDILDQFSEAFLRIGIDTELLQVNSDIEGAEYEKQSYIQFWHLLYSSEDDQKLKQNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPNLGRPDEIRVEMARELKANAEQRKNMTSNIASATRDHEKYREILKKEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEITMRVSVTTGTITDKLREDWGLVEIMKELNWEKYDKLGLTYTIEGKHGERLNKIKDWNKRNDHRHHAMDALTVALTKPAYIQYLNNLNAKAIGNKKGTEIFAIEQKYLKRENGKLCFIPPIENIRAEAKKHLSKILVSYKAKNKVVTINKNKTKKKAGFNEQTALTPRGQLHKETVYGKSFHYSTKFEKIGASFDAQKINTVAKKEEREALLKRLAENGNDPKKAFTGKNSLNKMPIYLDLGKNIKLSEKVKTVVLEQNYTIRKNIDPDLKVDKVIDVGIKRILESRLEEFGGNAKLAFSNLEENPIWLNKEKGIPIKRVKISGVSNVESLHVKKDHFGEKILDEEGNEIPVDFVSTGNNHHVAIYEDEDGNLQDEVVNFYEAVIRRNQGESIIKYRHEEGWNFLYSIKQNEFFVFPSQDFNPNDFDLLDPKNYDLISPNLYRAQKFSKVMYGNSAVRDYVFRHHLETVLNDVKELKDVAYKQLKSLQYLNGIKKVRLNHLGQIIQVGEY

SEQ ID NO: 993 - protein, 1397 aa, Joostella marina
MKKVLGLDLGTNSIGWALVNEATKEEKKEGKSSEIIKLGVRVNPLTVDEKTNFEKGRPLSTNADRTLKRSARRNLQRYKLRRRNLIEILIKNGFITKDTPLTETGKDTTHQTLKLRAKSAKEKVDLKDFAKILLTINKKRGYKSSRKVNSDEDGLAIDGMAVAKHLYEQNLTPGQYVLNLLQKNKKYVPDFYRSDLQEEFKNIWNNQKTYYFDILTDTLFEELKDKNKSQTWAICKKPFDIAGIKQIGKASDKRLERYKWRTEGLTQKLNLEYLAIALQEINNDINKSSGYLGAISDRSKELFFNKETVGENLYRQLVKTPHTSLRNQVFYRQDYLDEFETIWETQAKFYPQLTHTLKEEIRDVIIFYQRKLKSQKSLISFCQFESWEQTYIEKETGKSKTRTVGRKVIPKSSPLFQEFKIWQNLNSLEFRNSDEGEIIEFIKLDEDIRQTVFEELNLRGNLKPNDVLKILGNYISLGKVSQWKCNFEEIEGNRTNAALYNVYQIIAENEGYGFDWAKKTASEINKELKNIFPQLGIDASILDFDFTQANFDKQTSYQLWHLLYSAEEDFKISEEDKVLYGNSSVSLKKKLHQKYGFKPEYTKLLTNISLQPDYGNLSAKAICNILPYLKENNVYSEACDLTGYNHSNFLTAEEQAKRPLKPILELLKKNSLRNPVVEKILNQMVNVVNQVIETYGKPDEIRIELTRELKKSAKERANMTKSIADATRRNDDYRKTIIKEFGIPNPTKSDVVRYRLWQELASRGYKDIFTDTEIKPQELFSNKIDIEHIIPKALLFDDSFSNKTLAFKKDNLKKANRTAYDFIANDYAPNLENYIERVESLHKDRKITRAKRNKLLMLQSKLPDGFIERDLRNSQYITKEAKKMLYEVCRTVVSTSGSITDKLREDWDLINVMKELNFPKYKALGLTEKIERYDIGAEKMKEVEIIEDWNKRNDHRHHAIDALTVAFSTHSHIQYLNHLNARRDEGHKKHAAIIAIESTITEKEGNKKRRFIAPLPNFRLQAKEHIESILVSFKNKNKVVTNNINKTKRIKKDKFNTKVQLTPRGQLHKETIYGKIKQPLEKHIKLNKSFTLEQAKLIIDKRQREKVLNHLEKYAHNSDIAFNSKTLKKNPLLISDEPLKEVLCFEEVFTIRKDISYDNFKNEKQLDKVIDEKVKQALKERINQYNGDFREAFSDIERNPIWLNKAKGICVKRATIKGVSNAEPLHTAKNHLGEEVLTENKEQIPVDYVSTGNNHHVAIYEDEDGNLQEKVVSFYEAVIRVNEGLPIIDKEYNKSLGWTFKFTMKQNEMFVFPSEDFNPTEIDLLDQKNASLISPNLFRVQKFTIKDYFFRHHLETTVENNNTLKNTTWRREGLSGIYGIIKIRLNHLGEIVQVGEY

SEQ ID NO: 994 - protein, 1060 aa, Kingella kingae
MAAKSLNYILGLDLGIASCGWAVVEMDEQENPLRLIDVGVRTFEEAENPKDGSSLAETRRLARAQRRLISRRANRMNKLCRLLKQENVLQANDYDEKGLIIGLPNQAWELRAQGLDRKLEPKEWAAVLIHLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQGQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 995 - protein, 1314 aa, Lactobacillus animalis
MLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 996 - protein, 1371 aa, Lactobacillus buchneri
MKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDDSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 997 - protein, 315 aa, Lactobacillus casei
MFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAARGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDMVDCKINPNAVRTKKISFL

SEQ ID NO: 998 - protein, 236 aa, Lactobacillus casei
MFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAARGGVFAWMVRKDPDGNITPYNFDEKVDREASANTFIQRMKTTDTYLIGEDVLPKQSLLYQSYEVLNELNNVRVNDNKLSSSIFKSSATMITNS

SEQ ID NO: 999 - protein, 1389 aa, Lactobacillus casei
MIIRTYELKTITTIAILKMFQLLTGGLSMTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 1000 - protein, 412 aa, Lactobacillus casei
MIKDNSLDNRVLVHPLVNREKDTIFASTRFAKQTNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNPKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKK

SEQ ID NO: 1001 - protein, 234 aa, Lactobacillus casei
MKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 1002 - protein, 566 aa, Lactobacillus casei
MQILTDEVLKQKIAELNAHELKASGIYAAIDDAYTSPSNKKALRQVLSVIDDITNAAGQAPNWLYIETADGDGVPGKRTNSRQRKIQEIYVNAAQELITSSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKK

SEQ ID NO: 1003 - protein, 1363 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKMKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKVIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLTAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 1004 - protein, 1360 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 1005 - protein, 700 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKAIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLNAGMINSLANIRYRGWGQFSHKLLNELTLSTGRTVFEA

SEQ ID NO: 1006 - protein, 330 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKNRYKYEKRLFNDRTDAEFYQQYPTMYHLRNRLLTDPSKADVREIYFAIHHILKSRGHFLTPGDAKDFNTNKVALNEIFPALQDAYAQVYPDLDITFDENKMNEFKTVLLNEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSQAKVDD

SEQ ID NO: 1007 - protein, 330 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKNRYKYEKRLFNDRTDAEFYQQYPTMYHLRNRLLTDPSKADVREIYFAIHHILKSRGHFLTPGDAKDFNTNKVALNEIFPALQDAYAQVYPDLDITFDENKMNEFKTVLLNEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSHAKVDD

SEQ ID NO: 1008 - protein, 1361 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGNTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 1009 - protein, 1128 aa, Lactobacillus casei
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKDIQLIFMGAISERTRPILPL

SEQ ID NO: 1010 - protein, 1366 aa, Lactobacillus casei
MTKLGKPYGIGVDIGSNSIGFAAVDENSHLIRLKGKTVIGARLFEEGKAAAYRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAKEGDRDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQAVYYDWLAAPNPVEKHRQSMTYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGEFEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 1011 - protein, 1354 aa, Lactobacillus coryniformis
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 1012 - protein, 544 aa, Lactobacillus crispatus
KYYLYFMQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 1013 - protein, 298 aa, Lactobacillus crispatus
MDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKTSFQMNKNDQDFLF

SEQ ID NO: 1014 - protein, 279 aa, Lactobacillus crispatus
MNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKYYTR

SEQ ID NO: 1015 - protein, 538 aa, Lactobacillus crispatus
MQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 1016 - protein, 206 aa, Lactobacillus crispatus
MQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKRK

SEQ ID NO: 1017 - protein, 857 aa, Lactobacillus crispatus
MTKLNNEYMVGLDIGTNSCGWVATDFDNNILKMHGKRALGSHLFDEGVSAADRRAFRTTRRRIKRRKWRLKLLEEIFDEEMAKVDPNFFARLKESGLSPLDTRKNVSSIVFPTKKMDKQFYKKFPTIYHLRNALMKQDKKFDLRAIYIAIHHIVKYRGNFLSNSSISNFSASKIEIDRFVNELNDLYSIFLPESGVIFDAGNASKVEDIIRNEQMFKLDKIKEIADVLPDTENKSGLKLSKKISKEISKAILGYKAKFEIILQVNVDKTDSSIWNFKLNDENADVNLSEITSDLTDTQLQILDLVRNLFSAISLLNIVDEGSTLSESMIRKYNDHAQDLKLLKTVIKNHSDRKKAHNLQLAYDKYVNNRHFVDVETKKAFPNKHLYRKSDFYEIVKKNLDASKEAVQIRKEIALDKFMPKQRSDENGVIPFQLNQIELDKIIENQGKYYPFLKEINPIKAHRMQAPYKLDELIRFRVPYYVGPMIEPTNSSYPQTRQNQSFAWMVRKAKGRITPWNFDEKVDRQKSANNFIKRLTTKDTYLFGEDVLPANSLLYQKYTVLDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKTSFQMNKNDQDFLF

SEQ ID NO: 1018 - protein, 857 aa, Lactobacillus crispatus
MTKLNNEYMVGLDIGTNSCGWVATDFDNNILKMHGKRALGSHLFDEGVSAADRRAFRTTRRRIKRRKWRLKLLEEIFDEEMAKVDPNFFARLKESGLSPLDTRKNVSSIVFPTKKMDKQFYKKFPTIYHLRNALMKQDKKFDLRAIYIAIHHIVKYRGNFLSNSSISNFSASKIEIDRFVNELNDLYSIFLPESGVIFDAGNASKVEDIIRNEQMFKLDKIKEIADVLPDTENKSGLKLSKKISKEISKAILGYKAKFEIILQVNVDKTDSSIWNFKLNDENADVNLSEITSDLTDTQLQILDLVRNLFSAISLLNIVDEGSTLSESMIRKYNDHAQDLKLLKTVIKNHSDRKKAHNLQLAYDKYVNNRHFVDVETKKAFPNKHLYRKSDFYEIVKKNLDASKEAVQIRKEIALDKFMPKQRSDENGVIPFQLNQIELDKIIENQGKYYPFLKEINPIKAHRMQAPYKLDELIRFRVPYYVGPMIEPTNSSYPQTRQNQSFAWMVRKAKGRITPWNFDEKVDRQKSANNFIKRLTTKDTYLFGEDVLPANSLLYQKYTVLDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKNSFQMNKNDQDFLF

SEQ ID NO: 1019 - protein, 347 aa, Lactobacillus crispatus
MVNLKSLVLILKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 1020 - protein, 534 aa, Lactobacillus crispatus
RDAYTDKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 1021 - protein, 278 aa, Lactobacillus crispatus
SVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKYY

SEQ ID NO: 1022 - protein, 277 aa, Lactobacillus crispatus
SVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKY

SEQ ID NO: 1023 - protein, 1368 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPIDDTFFLRQKQSNLSPKDQRKLYTQTSLFNDRTDRAFYDDYPTIYHLRYRLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPGDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNSRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTRGVHENSGALFNQTLYAAKDDKASGQGGKQLIPAKQDRSTALYGGYSGKTVAYMCIVRIKNKKGDLYKVCGVETSWLAQLKQLTDEDSQKAFLEQKISPQFTKVKKQKGNIIEAVEEFEVIAPHILINQRFFDNGQELTLGSATYKHNEQELILDKTAVKLLNGALPLTQSEELAEQVYDEILDQVMHYFPLYDTNQFRAKLSTGKAAFMKLPWKSQWDGNKMVQVGQQVILDRILIGLHANAAMSDLKVLKMTTPFGMIQQSTGITLSADTQIIYQSPTGLFERRVALRDL

SEQ ID NO: 1024 - protein, 669 aa, Lactobacillus delbrueckii
MAKPKDYTIGLDIGTNSVGWVVTDDQNNILRIKGKKAIGARLFTEGKVAAERRSFRTTRRRLSRRRWRIKMLEELFDEEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERNILSVQTLEELNDLFAENEGTEEVELNVASAEQINDILTGGHLNADSQKEISNLLLPSSFPSFDDKAKEKQVKKLINNVATNISKAWLGYKADFSTILNLAKVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVKKRHADLAKAMKLTGIKKRSELLDPEELKKGISSLLDDSPEAVEIKQRLEEKTFLPLQRSNNNGVIPNQLHQVELDEIIKKQSKYYPFLAEKNPDESEEAQKKAPTKLDALLTFRVPYYVGPMITKEEQEAQNGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQR

SEQ ID NO: 1025 - protein, 544 aa, Lactobacillus delbrueckii
MTGCADYDVDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDFHHAIDAYLSTIVGNYLYQVYPNLRRMFVYGEFKKFSSNAEESAHDVARRVKSMNFLDDLLRGTHGDNIYCRSTGEIVFNRNDIISKLKQAYSFKQMLVTQEVFTKKSALFDQTVYPSPERDSKKRSGLIPRKKGMDTEIYGGYSGNKDAYFVLAEAVKEKGHTLQIVGVPIRALNTLKNSANYSEKLLEIIKPQVMFNKDTGKPIKGIKDVKILMDKIPCRQPVLEGESYYMLASSKYRYSLKQISLSQMSMKYILDYIDDPNFNKHEMINIDQQDEKECLLSVYDEILEKMDKYLPLFDIRSFRKKLHDGRDAFIALPVASEEKKPGEVDVIRKILKGLHANADITNLAELGFGTAALGALVSTGGIKISDDAVFIYQSPTGLFERRVKVSDLLK

SEQ ID NO: 1026 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 1027 - protein, 1313 aa, Lactobacillus fermentum
MHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIMKYRGHFLNNASVDKFKVGRIDFYKSFNVLNEAYEELQNGEGSFTIEPSKVEKIGQLLLDTKMRKLNRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKVSDVASLVMAKTRGVNKPSVEGLSDPKKFNSNLATYLDLKSIVGDKVDDNRYQTDLENIIEWRSVFEDGEIFADKLTEVEWLTDQQRSALVKKRYKGWGRLSKKLLTGIVDENGQRIIDLMWNTDQNFMQIVNQPVFKEQIDQLNQKAITNDGMTLREWVESVLDGAYTSPQNKKAIWQVVRVVEDIVKAVGNAPKSISIEFARNEGNKGEITRSRRTQLQKLFEDQAHELVKDTSLTEELEKAPDLSDRYYLYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKKRPVDLYGAYTNGTSAFMTIIKFTGNKPKYKVIGVPTTSAVGLKRVGKPGSESYNQELHRIIKSNPKVKKDFEIVVPHVSYSQLIVDDDCKFTLASDTYQHPATQLVLSKESMEIIADDFKFVKENTATADEQLVRVFDEIVNQMNHYFTIFDQRSNRQKVTKARDKFVSLPTESEYEGAKKTQVGKTEVITNLLMGLHANSAQGDLKVLGLSTFGFFQSSGGLNLSEDAMIVYQSPTGLFERRICLKDI

SEQ ID NO: 1028 - protein, 1327 aa, Lactobacillus florum
MTEQQQPYNIGLDIGTSSIGWAVTDQNDKLLHIRGHNGIGVRLFKEGESAAERRGFRTTRRRLSRRRWRLRFLDRIFDAELAKVDPNFLARLKQSNISPLDPNKQMFGNILFDDPQFDDQKFHQQYPTIYHLRSALAQPDAPQADVRLIYLALHHMIKFRGHFLNGAAVEKFHGGQLHLESEFQELNQIFSNQQRDHVQLQTSSLDEVATILKDNQRTPSDRQRELSARLFVPVDKTIDKENKKLATELLKAVLGLKAKFDVILGVEATDPQAFKLQFSSDDFDDKIAELASELTDEANEILTVLQRLYFSLNLADILTNRQTKQVADSISTAMINRYDDHKHHLKMLKELEAQVTQEQRDGLKKAYDEYIDGDKPTIDTFYTNIKKNLDDSELANQIKSLIDLQAFMPKQRSKENGSIPHQLHQRELDQLIEVQGKYYPWLLAAKDKLDALIAFRVPYYVGPMIDPNQSDDPQNTKFAWMVRKEAGEITPWNFEEKVDKTSSATNFIKRMTTTDTYLLGEPVLPKNSLLYQQFTVLNELNKLKVNGKALTVDQKKYLYEHVCKKQRRVTLKKLSDCLMARGDFPMGAIFTGTTDQKNMNNTLKTYQDFQEIFGDEIDNPDRQVDFEKMIEWSAIFEDREIFKLKLAELNWLTSEQLERVSKKRYQGWGRLSQKLLTHIVNENGERIIDQLWNTNQNFMEIMGQDSVKQAIQEHNGANVAQTGINETIDELYTSPQNKKAIRQILLVVDDIKKAVGYAPANIMMEFAREDRDDHRLIASRARQLEKTYQEISKNWFDNESVTQELKDQIKNKTKFTDRLYLYFIQGGIDLYTGHPLNIDQLSSYDIDHILPQSFLLDNSLNNRVLTSQAENRVHKEDRLPGETVANKMRPTWKMMREQGLMTQRKYNNLTLKPDQISKFNNRGQFINRQLVETRQVIKLAADIMSQKYQADQTKVVTVKANLTHHMREKFNFYKSRNVNDYHHAFDAYLTLFVGNWLLKEYPKLQPYFVYGDFAKTGTNNLKSFNFLYRFERDHKLNDKGAIDTDKDQQLGYMKRIYRFKKMLVTKQLETNEGALYGQTLYPAPKNDKKTRNLINSKKNRPSDIYGGYSNENGSFLTLVKLKKGSKYDYRLVAVPVSKISEIKESELATIEKAIAPQFLKSSGKYRDFQVVLSKILINQKVIDDGMIFTIGSKSYKHNAKQVVLSDNSIQIVSTLSRISDKEKLITVFDEIVDITSKYLPWYKVNDVEKTKMLFRQMQDIDEMKKIIDNSLIGLHCNASITDLGKVGLSKYWGRFVLTAGISLTVDAQLIYQSPTGLFEHRVKVSDL

SEQ ID NO: 1029 - protein, 1386 aa, Lactobacillus hominis
MTKITEDYIVGLDIGTNSCGWVAMDSKNTILRMHGKTAIGSHLFDAGNSAADRRAFRTTRRRIKRRKWRLKLLEEIFDSHLAKVDPYFFARLKESGLSPLDTRKNVSSIIYPTSLEDKKFYVDNPTIYHLRYKLMTEDRKFDLREVYLAIHHIVKYRGNFLYNTPVKAFEASKIDVKGSLKKLNELYEGLDSEFNVELDSNNALEIENIIRDKKIFKINKVKEINQLLSLKTEDKERTKLMKDVSKQIVNAILGYKTKFETILLKDVSKDEADDWEFKLTDVDADNKFENLIGDLNENEQEILLVIRKLANAITLSNIVEEGKTLSESMKDKYKKHSDDLKLLKQVISDHPDRDKAKKLALAYDLYVNNRHGKILQAKDILEKKKTLSKEDFYKEIKKNLDDSKESQEILDAISLDSFMPKQRTNENGVIPYQLHQLELDKIIENQGKYYPFLKEVNPVSSHLKQAPYKLDELIRFRVPYYVGPLISPNESTKNKQTKKNQNFAWMIRKEQGQITPWNFDQKVDRMASANKFIKRMTTIDTYLLGEDVLPANSLLYQKFTVLNELNNVKINGKRISVPLKQELYNNLFKKNSTVTTNKLKSYLKENYKLIKVEIKGLSDEKKFNSGLTTYNKLKNLKIFDQQIDDPNYNKDFERIIEWSTIFEDKAIYKEKLKTIDWLSDRQIDKLSKIRMQGWGQLSKKLLSQLTDNNGQTIIEQLWDSQNNFMQIVNQADFKDAIAVANQNLLVDTSVEDILNEAYTSPANKKAIRQVVKVVDDIVKATSGKVPKQIAIEFTRDADDNAKISQSRANKLRKVYKEMSNELASETIRNELERVAKDQKLLKDKHYLYFMQLGRDAYTGELIDIDNLEQYDIDHVLPQSFIKDDSLENRVLVKKAVNNGKSDNVPVKLYGNRMATDLGMTIRHMWEKWKEQGLITKTKYNNLIIDPDKINKYESSGFIHRQLVETSQIIKLVSTILQSKYPDTEIIVVKARYNHYLRKRLNLYKSREVNDYHHAIDAYLSAICGNLLYQVYPYLRPFFVYGQYKKFSSEPEKEKIIYDKTRRYNFISQIFENKDNDIISRETKKKVFDKKDIIEKLKRAYNYKYMLVSRETETHDQEMFKMTVYPRLSRDTKKSRNLIPKKKDMPTEIYGGYTNNSDAYMIIARINKKKGPEYRVFGVPMRELVNLRKAEKNGHYKAYLKQVLEPEIMYSKNGKKNKTISSFEIVKAKVPYKQVILDGDKKFMLASSTYVQNAKQLTLSQYSMQAITDNCENDTEEEKALVEAYDEILTNIDKYLPLFDINKFREKLHAGREKFVDLPLAEKKETILQVLNGLHDNAVMPKIKSLGLSTPLGFMQFHTGVSLSENAKLIYQSPTGLFEKRLKISDL

SEQ ID NO: 1030 - protein, 270 aa, Lactobacillus iners
MITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKYLIINLNIMTFC

SEQ ID NO: 1031 - protein, 255 aa, Lactobacillus iners
MITYLKDNDDITLSFPKDQLINIFKNSNLNSTEKSDQLKPFFGRTNLEKGIIKLLSGGKQDLSNMFRDETLKNSNYKNLKFSDNTFDDERDGYAADLGDRINLLILLKQIYDASILESMMSQARVSIDGHKYISSAKVCAYEKHKSDLKRLKSLIKKYLPSEYNNIFRKITEKDNYVAYSKSNITNNKREKALKYVEYVDFTKYLTKKLKTIKTQDAEDDKEIFEIKGELEKQSFLPKQRTLDNSIIPYQLHLME

SEQ ID NO: 1032 - protein, 343 aa, Lactobacillus iners
MLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKIDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKYKIDEINKSYYQHDKFNYKSMIDSLYVSPATKRILWQSLKVVHEISKIMKHDPEKIFYRNGTFQRRSS

SEQ ID NO: 1033 - protein, 447 aa, Lactobacillus iners
MLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDSKTNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVISKYTNSVFGKSMLISDKYRKDIFKSVDKSILEFNSLNTIAKADNLLKFVTSMRPAGSVDALKMVGLIERIRKSNVISNFNEFKLINQSVTGLFENEEDLLKL

SEQ ID NO: 1034 - protein, 667 aa, Lactobacillus iners
MQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 1035 - protein, 1395 aa, Lactobacillus jensenii; identical to SEQ ID NO: 113

SEQ ID NO: 1036 - protein, 1382 aa, Lactobacillus mucosae
MDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 1037 - protein, 1382 aa, Lactobacillus pentosus
MKKIVNYNLGLDIGTSSIGYAAIDDQGRPVRHQNKTVMGVRLFKEGKTAESTRIFRGTRRRLSHRHWRLGYLDRIFDNEIAKVDENFLPRLKASKRARSDEKRSFRGSLLFPETGDDAYYQKYPTIYHLRYALITQKKQFDIRLIYLALHHMIKYRGNFLDTTPVSAFNIHDIDLTDQFASLNDCYQLLDMDFEFQFDLNNIEQVQKLLLDETLSKTKRQAAVSKVLVMSTGNKAFDDQQNGIASEFIKALLGGPFDLSKILNLSVADVKSWKLHMTDKDVDDTLNSLVEELDENHKQIVNLLQMIYSQVMMLGLLNGQQSISASMIERYDDHAKHWAALKKLLPALGEQEQSTIIHAYTAYTGHSRTKQLSRAEFYTKVNSILKKHENIAEATGLIELIDRNEFMPKQRDAVNGVIPHQLHQRELQLIIQNQQKYYPFLAAKAYPDADETMIEQLLSFRVPYYAGPLVDRDFINESSDQEQAMQNTKFSWLKRREAGEITPWNFEQKVDVQETANRFIKRLTTKDTYLMTEDVLPKESLIYQRFEVLNELNAIRINDRRLTAENKQLAFQQLFMAGNTKNVSIKKFRNFVFDSLKFPEKVKITGFAGQHNFLAKLSTYHDFKKIFGERVDHTDLQPDFERIVEWCTIFEDRHIYREKLKEIQWLSQSEIDQLVLIRNHGWGRLSKRLLTGIRDSDGRTVMDQLWFGTDNFMRIISQSDFAAAIANENRTQLNQHGLEDVLDSAFMSPQNKKAIRQVLKVVDDIEQTLGCPPKKVMIEFTRSPDKKKQRTVTRLEKVQQAYKAVADQLAGQSIVSELDQYANTHSKLSDTYYLYFMQLGRDLYSGKPIDIDSPMLDDDHILPRAFMKDNSLDNRALTEKPINNTKAAKFPSKVFGQQKEVTDFWKLLRRCGLMSNIKEKHLYLDPDNVDKWTRRGFIHRQLVETSQVIKIVANILNDRYQQSQTEVLEVPARLGTELRECFGWYKVREVNDYHHVFDAYLAAFIGNYLYRRYPKLQPYFVYGNFAELNKAQLKNIKSFNFLYNITDNKRVVKDIETGQTLWDDQIRQQIQHIYEYKYMLTSHEAFTQHKELYGQTIYPRREFKPGTLKAIKQDQPQELYGGYKNLTAAYMCIVKIQARKRRAAEYRVVRVATESLSALQQAKRLGVQAYERCLRQELVRNNEILRTNADPNSAPREFEVLLDRVLCHQMIISDGQKYLLGSHAYKINCMQLVLSNNSMKILSTSIVKLKQMTNEPLVQVYREILDVVNKYFTLYDVNSFRENLNQFFDKFRTLPITNEYESSKSGKKLIHRGQLETLTLILRGLHANSDKVQYGDQSTLLGGFQTKDGIKLSKDSVIQYTSPAGLNVRTVKLRDLEQKEAQK

SEQ ID NO: 1038 - protein, 1361 aa, Lactobacillus pentosus
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKAYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYRKTPQITGLADPKGFNSSLSTYHDFKKILLEAIADEHKRADIEKIILWSTTFEDSAIFKQKLEEVAWLTDAQRKQLSGLRYRGWGQLSHKLLTAFKDDKGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASYNKSKTLVPKKNHMETSVYGGYSNQETAYLAIVRIPFKSGFKFIVVGIPTRMVAKIKHYQSLGATLNQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVASQAHQSFEGLKNNVQTSDKQLGKKEVLNSLFVGLHANATRSNLSVLGMSKDFGRIKSNGITLTDQAEIIYQSPTGLFERKVALKDL

SEQ ID NO: 1039 - protein, 1358 aa, Lactobacillus pentosus
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDQEFYHDYPTIYHLRDKLMTSDRKFDIREIYLAIHHIVKYRGNFLRTGPASQYGSASLHLATSFQKLNDLFAQSEESLNFKLVTDEAQLQQIQQILVRTDLSRSEQQRQIWPLMVVLMGATAAEKKRQKDFAKELANALVGLKAKLNVVTLTNVDTTVVKDWTFTLEESQDKLPEIEEQLSEVGQQIMDEVIQLYASVNLAQLIPAGKRFSQHMVEKYNHHEKNLELLKAYIHSQSDSKRGREIRATYDRYIDGVKSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDQKLAPRQKQRLYNQVFKQHQHVSVKNIQQNLMDAGEYRETPKITGLADPKGFNSSLSTYHDFKKILPEAIADEHKRADIEKIILWSTTFEDSAIFKQKLEEVAWLTDAQRKQLSGLRYRGWGQLSHKLLTAFKDDNGRSVMDGLWETSDNFMQLRKQPAIETQIKEANQANLTDADIQDTINELYTSPQNKKAIREVMLVLDDIKNAMHGQTPSWIFIEAARGGGVAGRRTQSRSKQIVEAYKSTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPSASIVAVKANLTHQFRQTFNFPKLREVNDYHHAFDASLTAFIGMYLLKQYPKLERFFVYGKFAKQPINLTRFNVIRKLAVAEEPIANIETGEILWDKTADIKCFEKLYNYKRLLVTHEVRENYGAMFDQTIFKATDSRKRLIQKKKGFATETYGGYTGRTLAYLAIVKVVTNKDTQYQVVGIPTTMVTQIQQLEASGLTSKQAVTKAIGAMINENNKKLQSYEVLLPKVRFEQVVRDEVKGHIHRFALGTDTYYHNIQELYLPLTIQRAFLGKRNDTDAQTEQNLLTVFETTLAQVNRYFPLYEMNKFKQILNSAQEKFAALPTKNKTVKNKLVTGKDGVLNNLFIGLHANASLGDLKILGMKIGFGKLQVPGGLKLTDQAEIIYQSPTGLFERKVALKDL

SEQ ID NO: 1040 - protein, 1358 aa, Lactobacillus plantarum
MKEPYGVGLDIGTNSVGWTVVDASGHVRKIKGQTGIGVRLFKEGAAAADRRGFRTTRRRLKRVKWRLRLLREFFDQPISKVDINFFARRKYSDVSPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIISNQKEYYPWLGEENPVIKRRGKFPYKLDELFGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAREFPTAPRITGLADPKVFNSSLSTYHDLKQVLPEAMSDVRKQADIEKIILWSTIFEDSTIFKQKLTEISWLTAAQLKQLGQLRYRGWGQLLRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVRDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKIDFGKLQVPGGIKLTGDAEIIYQSPTGLFERKIALKDL

SEQ ID NO: 1041 - protein, 1361 aa, Lactobacillus rhamnosus
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQEHYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 1042 - protein, 1361 aa, Lactobacillus rhamnosus
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 1043 - protein, 1352 aa, Lactobacillus ruminis
MNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 1044 - protein, 1339 aa, Lactobacillus salivarius
MERYHIGLDIGTSSIGWAVIGDDFKIKKKKGKNLIGTRLFNEGATAAERRGFRTQRRRLNRRKWRLKLLEEIFDPYMAEVDEYFFARLKSSNLSPKDSNKKYLGSLLFPDKSDSNFYDKYPTIYHLRRDLMEKDEKFDLREIYLAIHHIVKYRGNFLEKVPAKNYKNSGASIGFLLEEVNSLYKDIIGDESIAILNSEKFEDVEKIILDEETRNLDKQKSVGKLLVEDKKKKNIVTAFSKAIFGYKFNIEDLLLIENDEKNKLTFNDENIDDIFNELSHSLDDKQMDLLTKTREIYFKFKLNMIVPTGYTLSESMIEKYEMHKAHLKMYKEFINTLNTKDRKILKNAYSDYINTEKAKAANAQENFYKTVKKIIKDNNSDTAKKIIVLIDEGNFMPKQRTGENGVIPHQLHQIELDRIIENQAKYYPWLAEANPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKFKVLNELNNIKVNEKKLDIEQKQDIYLNLFTTAKNVTKKSLATYLNCSADSISGLSDGEKFNSSLSSYIDLKAILGNIVDDCNKNEDLEKIIEYSTVFEDGNIYKEKLSEISWLTDEQIEKLSNIHFKGWGRLSKKLLTQITNENGERIIDALWNTSNNFMQIINDESIQAKLAEINGKYAGKSDLEDILSEAYTSPQNKKAIRQVMKVVEDIEKAMQCEPTSISIEFTRKKQKSRLTNTRYKKISDVYEKIADEVISEYELRKLQSELDSNANNMRDRYYLYFMQLGRDMYTGEKINIDELHQRYDIDHILPQSFIKDDSINNRVLTRKDVNNKEKSDKTAADLYAVEMSDFWRKLRKQGLITEQKYKNLLTKSDSIDKYAKKGFIKRQLVETSQVVKLVANILQDKYSDTKIIEVRAKLNSNLREEYKLIKNRAVNDYHHAIDGYLTTFIGQYLYKTYPKLRSYFVYNDFKKLDSNYLKHMKKFNFLWQLQDDKTIDIYDNVNNKFVLNVPEMKKYIQKIYNYKYMLVSKEVTTKNGAFYDQTKYNAKTVNLIPIKKNKPTNIYGGYKGKVSSYMMLVKIRKKKEVIYKFVGVPRLWTDELDRLKDTTERKILLNEIAKNSLSKTEQDFEVILDKVYYGQLIIDGNQKYTLGSSEYKYNAMQLHLSKHALEVLAKENVKDAEITDKDLVSVYEEILSVVNKYFELYDINKFRQKLNEGLEIFRKLPVYNVYESNKIKQVGKFEVLNRILMGLHANAMITDLKVLGIKTKLGQMQVNGGIKLSPDAKLIYQSPTGIFSRAVRVKDLG

SEQ ID NO: 1045 - protein, 629 aa, Lactobacillus salivarius
MERYHIGLDIGTSSIGWAVTGDDFKIKRKKGKNLIGTRLFKEGNTAAERRGFRTQRRRLNRRKWRLKLLEEIFDPYMAEVDEYFFARLKDSNLSPKDSNKKYLGSLLFPDISDSNFYDKYPTIYHLRRDLMEKDEKFDLREIYLAIHHIVKYRGNFLENVPAKNYKNSGASIGFLLEEVNNLYKDIVGDENVTILNSEKFEDVEKIILDDGIRNLDKQKGVGKLLVEDKKNKNLVTAFSKAIFGYKFNIEDLLLVEGDEKSKLTFNDENIDDIFNELSHSLDDRRMDLLTKTREIYFKFKLNMIVPTGYTLSESMIEKYEIHKAHLKMYKEFINTLNSKDRKILKNAYTDYINNEKAKAANAQENFYKTVKKTIKDNDSDIVKKIIDLIDEGNFMPKQRTGENGVIPHQLHQIELDRIIENQAKYYPWLAEENPVEKNRKFAKYKLDELVTFRVPYYVGPLVDKTESNKNEKETKFAWMVRKSKGTITPWNFENLVDRTESANRFIKRMTSKDTYIIGEDVLPASSLLYEKFKVLNELNNIKVNEKKLDIEQKQNIYLKLFTTTKNVTKKNLATFLNCSIESISGLSDDKKFNSSLSSYIDLKVILGDIVDDYSKNEDLEKIIEYSTIF

SEQ ID NO: 1046 - protein, 897 aa, Lactobacillus salivarius
  misc_feature (822)..(822): Xaa can be any naturally occurring amino acid
MLIESDEKNKLTFNDENIDDIFNELSHSLDDNQMDLLTKTREIYFKFKLNMIVPTGYTLSESMIEKYEMHKAHLKMYKEFINTLNAKDRKILKNAYSDYINNEKAKAANAQENFYKTIKKTIKDNNSDTAKKIIGLIDEGNFMPKQRTGENGVIPHQLHQIELDRIIENQAKYYPWLAEENPVEKNRKFAKYKLDELVTFRVPYYVGPLVDKTESNKNEKETKFAWMVRKAKGTITPWNFENLVDRTESANRFIKRMTSKDTYIIGEDVLPASSLLYEKFKVLNELNNIKVNKKKLDVEQKQHVYLDLFTTRKNVTKDNLATSLNCDVESITGLSDNEKFNSSLSSYIDLKAILGNAVDDCNKNKDLEKIIEYSTIFEDGNIYKEKLSEISWLTDEQIEKLSNIHFKGWGRLSKKLLTQITNENGERIIDALWNTSNNFIQIISDESIQAKLAEINGEYADKSNLEDILDEAYTSPQNKKAIRQVMKVVEDIEKAMKCKPTSIAIEFTRRKGKSKLTNTRYKKISETYEKITDELISEYELGKLQSKLDSKANNMRDIYYLYFMQLGRDMYTGEKINIDELHQYYDIDHIFPRSFIKDNSLNNRVLTRKEINNNEKADRTAADLYAVKMGDFWRKLRKQGLITEKKYKNLLTRTDSIDKYTKQSFIKRQLVETSQVVKMAANILQDKYSNTKIIEVRARLNSDLRKEYELIKNREVNDYHHAIDGYLTIFIGQYLYKTYPKLRSYFVYDDFKKLDSNYLKHMDKFNFIWKLEDKKAEDVYDNVNNEFILNVPKMKDYIQKIYNYKYMLISKEVTTESGAFYXZTKYNAKTINLIPIKKDKPTNIYGGYKGKVSSYMMLVKIQKKKEVIYKFVGVPRLWTDELDRLIDTDEKKALLKK

SEQ ID NO: 1047 - protein, 1419 aa, Unknown
  Lactobacillus sp. 66c
MAKPQNYTIGLDIGTNSVGWTVTDDQNNILRIKSKKAIGARLFEEGKVAAERRSFRTTRRRLSRRKWRIKLLEELFDEEISKVDPNFFARSHESWISPKDKRERYSAIVFPTPEEDKKFHNEYPTIYHLRDRLMKDDQKHDIREIYVAIHHIMKYRGNFLHDESIETYRSGMSSLGGGDERTILNTKILDDLNDAFADNLATQGISVNSASADQINEIVTSGHLNVDSQKAIAKLLLPTTLSSDDKKQDKKIKKLATDAAKNVASAWLGYKANFAAILNIQEVDKDKKKIYSFALQGADEEDKVETLESVLSQDQIEIVDRIIRIRHAIVLGEIIPVGMTLSEAMIEKYDQHAKDLKNLKTVIRNLKDRKNAVKLQAIYDLYVNNRHADTAKAMKLAGVKKRTELLEPEEFNKSIEKLLDDSPVSAEIKKRIAEKDFLPLQRSNSNGVIPNQLHQIELDEIIKKQSKYYPFLGETNEHASADVARKAPTKLDQLLTFRVPYYVGPLITKEEQEEQDGHSFAWMIRKNPKDHEKITPWNFDEKVDRMASATQFIKRMTTKDTYLLGEDVLPSSSLKYQLFTVLNELNNLRINHKKLTREEKEQVIEDLFKKYKTVKADKFKNYWQKGHAGLDVKIQGMADPEKFNSTMSTYIDLQKIFGDQLDDAQRQNDFEKIIEYSTIFEDRKILGEKLRADFVWLSEDQIKRLCRLRLQGWGRLSLKLLTRLTDADGQNVLERLLNSNDNFMQIVKDPVIKAKIEQKNQKLLRADWSENATESILDEAYTSPQNKKAIRQVMRVVHDIVKACDGNLPAKFAIEFARSQDDDPKRTVARADRLQKIYAQISDEVVSQGVKDQLSGMKSLKDRYYLYFMQGGRDAYTGKPLNIDRLSDYDIDHIMPQSFIKDDSLDNRVLVTRAVNNQKSDNVPVLLYGNHLVADLGITIREMWDRWQKSGMISKRKLANLLTDPATLSEYRAEGFINRQLVETSQVIKLTATILQSEFPDSKIIEVPAKYNSILRKQFDLYKSREVNDYHHAIDAYLSTIVGNYLYQVYPNLRRLFVYGEFKKFSHGEEESSHQAVRRVKSMNFLDDLLRGKHGDDIYCRVTGEVIFSRKDIISKLKQAYSFKQMLVTQEVFTKKSALFDQTVYPSPARDSKTRSGLIPRKQGMDTEIYGGYSGNKDAYFVLAQVVKSKGHTLQVVGVPIRALRALANCSNYSEQLLKIVKAQVLFNKKTGKAKKGISDVRILLDKIPYRQPVLDGSAFYMLGSSTYKYNLKQISLSQQSMKYILDYIDDPNFNKHEMTKIDQQNEKECLLSVYDEILDKMDKYLSLYDINGFRKKLHVGRDKFIKLEVEKQAEAIKNVLRGFHANSDMTKLSDLGLSTSLGFMQASDGIKLSDNAVFIYQSPTGLFERRVKVSDLLK

SEQ ID NO: 1048 - protein, 1289 aa, Lactobacillus versmoldensis
MRRRYRRRRNRLNWLDELFADELAKIDPSFLLRMKNSWVSKKESTRKRDPYNLFIDEKYNDVDYFNQYPTIFHLRKELITEDKKVDIRLIYLAIHNIIKYRGNFTLENQNFDISQLSSNFSQQISDFFALFSDFGVIMPEDFDPDKISDILLNPNLSPSGKVSEAIATISPKTNVKAKIKIILLLLVGNNGDLKKLFDLETTEKIAVKLSSRHIDSELPIILSELNEQQENIITIANSIFGSIILKDFLGDETSISAAKVISFEDHKQDLQKLKTMWRETSNKEAVKAGKKAYEDYIGHEDSETFYKKIKKFLEKAQPVDLANKALAEIELENYLPKQRNRNNTVIPYQLNENELIAILDHQEKYYPFLKENRDKILSLLTFRIPYYVGPLQDSNNNRFSWMTRKASGAIRPWNFSEKVNVEQSSNDFIKRMRSTDTYLIGEPVLPKKSLIYQCYEVLSELNNTRVKDGSSNPKRLDVTIKQRIYNEIFKNQKSVSVKVLQNWLIKESYFKSPEISGLADKKKYLSSLSTYIDFKKIFGQRFVDDPVNSPQLEELAEWLTLFEDKKILLIKLQNSKYSYDQATINKLSTMRYQGTGKLSKKLLVDLKTTKKSIGKSGAESLSILDLMWSTKDNFMQIIHDADYTFEQQIKEFNYDTEDELTPLEKVANLHGSPALKRGLNQSIKVVADIVKFMGHDPEKIFIEFTRSDDFSKLTISRYRRIKKQYLEIAKAIKKIPAEFKDIKEYQTQLEENKGKLASERLMLYFLQCGHSLYSNKPIDLNMINSSKYHVDHILPQSYIKDDSLENKALVLASENENKIDNMLISHDIIATNLPRWQALKDQNLMGSKKFADLTRTTVTENQKKGFIQRQLVQTSQIVKNITLILNDLYKNTSCIETRATLSSEFRKAFSNFDETTYHYQFPEFVKNRDVNDFHHAQDAFLACVIGEYQLKKYPKDNLRLVYDQYSKFLDSLKKDTRKKNGRMPRYTQNGFIIGSMFNGKTYVDDNGEIIWDQKIKESIRKTFNYHQFNVVRQTIEQHGKLFNDTIQPHSDRYKLIPLKTNRDPAIYGGYNNDNNAYSVVLDVDGKKKINGIPIRIANQLKSDELDLSSWLENNIKHKKPMTILIDKVPKYQRIINEETGDLLITSANEVINNVQLFLPSMYTALISLLDSTKTEMYSKLLSNYEANILIDIYDYLLTKLKNNYPLYRKEWAKLAEHRDDFIESDLVTQASTLQQLIKFMHADPSNVNLKFGNFKGNRFGRKNGNIKLSKTDFIYESPTGLFKSIKHID

SEQ ID NO: 1049 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKNFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGGSSDKTLEQAIEKQNIQWEEKFQRIINASMNICPYKGASIGGQGEIDHIYPRSLSKKHFGVIFNSEANLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 1050 - protein, 907 aa, Leptospira inadai
MAKSIEEIRSIQNEFVVEYSILLKKIKKGEIDKKNDVYKVYQNTIKSSERLEQVLKERLGFQNVSKSYFNNPYSIAQLYNLISVDRSGFSKVCRSCQEENHWRSTLIDTDRGPQAQASKQVSDTGRPFDGQLAMLLDRIAFEIVKLKRIEIERLLSNKNSSKIEVVEIPLLIEENSFNFRYELAELKKLSKKKKDQLKKSVEEFDTKLNSKQERIKAASRELCPYTGKKISKGEIDHILPRSWTQKQFGTALNAEANLIYASREGNQSKGNREYGLNDLDEKYLNIIFGTKEVDSIQRNISDTIDRLDIERGTTRIVFDRLAPNERDCLRHALFIKSLRPKVFELLSGQLKARVNGTQLYLAKRIRSLLLKNQDFITKSLIIKVPSFSFYEPRTVDLPYMRKELAEKFPNLGKQNPQPTGSHIIDAAMVMAYAVETDSGNLSFGSKDKSEGFDSESLSRFLPSNIQFLSIKSKDKTDSKYPYKKPLFKDGVFGERFLPILIAEKGLRVGYTLENSLEVNSENPEEFFNVLKPYLLFKRKPIESNYQTLVAFAQKDKRGYIVLPVNKPKALESISQRKSDPHTSILKNILYTVSRESIPSLIFDKNTLIPEIKSNKVNWGDKLEKKFRIKIEIKLYGKKIADGFIRYPGKTEWEKLLLTEPLKGLVKNKTLTPKWFDSLENLAGLDDHFKDTSNPEAKHKRKSNHYALPVPKGPSGGFRIRRNSFDGYKVYQLYSVDGNSFHAFKIENGWTGKTLLLDIYQNSGNLHSLDYDYENTDISQTALFSKFYKIEFSKEETQKINSKGIKSLYVAPGSSSRQYIRVIFDKQTFSKFIKFQSKFWEFDLITPLPKDKAKDLIESILKIFPEDLRPKKPRNDIHIQNISHDSVQVEYIADGKTQGFGQYFINQN

SEQ ID NO: 1051 - protein, 418 aa, Leptospira inadai
MILKSPIAIDLGAKNTGIVYTTYQPNALPTEIHGATIISDNLKLSQVDRRAKRHQRRNYTRMKLARRLVYLIIRYHYRIPEQDLTPEVKTSLQSLLTRRGYTFQSIETEGNELGQAPWGEIEDYFPNVQDYEKSLPIQTVLYHFFSSENLELNKLVPSKEPETKEDKNILKYIREQKEAFESEQNNGARHRLKYFEEIKEDFPRKIKLMECLQKNKIEEKKFLNLIQNISNLQIKPLRAYFNDKDMKEKEIWEPRRLHTYIARWIRSWHIDPKNSSKRLIRQKLLSQLENGKLKIIRDTSIYSPSKDIISFLEEIDPKDTIPPYEDQNNRHPPRCQNLWLDGKILDRYFPGWEQSLWKLIRNEKNNPFEQLITKDFRTDDTISEGKSLSEQIQIYERSHSNIKLDVRAVILQRFLDRS

SEQ ID NO: 1052 - protein, 125 aa, Leptospira inadai
MSAYDRSANLDPWSLRLQGKAKKEIKTTESLSKTDLQKASDAYEKIKEILSESDTDQFIKLANRYYLEVADIKKGMWLPTAPERKHKEIPKSIAHEENQDISLFHKCNTKTGSKKRISQVSLEMF

SEQ ID NO: 1053 - protein, 1355 aa, Leuconostoc gelidum
MTYSIGLDIGTGSVGWAVIGDDYRLKRAKGKNLIGVRLFDSATTAAERRGYRTTRRRLSRRHWRLRLLNDIFASDLAEQDENFLPRLKYSWVNPDDEQNPQLNSDVANGALFGSSETDKAFHKNYPTIYHLRHELMTDTAKHDLREVYLAIHHIVKYRGNFLNTADKINAENSFNVDLFIAALDEYNEFLETPITSIKDAQLFSDKLTDINARNKSVRVENAMSETYDDKSKIFKAILTALVGNTANFQTIFDLSDLEKDEAKNFKFKLDLEDVETKLDVVRAKLSDEQNAFLEAVLIAYDGITLKMILGDYKSISQSMIESYKSHQRDWKYIKNNVRLNEQKIEPDKNSVKFFKLDPKKLIYPSNLAYLQVISSNEDEHRKGLDYFKTAIQDADILQRIENDTFLPRQRTKRNGVLPYQLHLAELEQIIKKQSKYYPFLANIYTQDNKTENKLIGLLKFRVPYYVGPLVEAEKVTGDGKNHWLIKKELQENTPITPFNFDDVVDKDKSGEQFIKRITGTDSYLIGEPTLPENSLLYQKYNVLQELNNVRNERHQRLPIKVKQDIFEHVFKIDKNVNAKKVMAYLKLNGYGDFQIAGLSDTRTGKFNSNLSSYNYFVDLLGREKTEKIREDRLEEIIEIQTVFEDKILVAKRLSNLDFLTPQEKSKLSAKHYTGWGRLSQKLLTTQFIKTALSEAGDIIPQSHSIIDLLYYTDKNLMEILNDKTFNVRNWLTEQNKGTESGNSLYDQIDALAGPKDIKRGITQVFSIIDDIKKAMGSNPETVYLEFARETQTSRLTNSRLNRVQEIYNSPELKTEFAYLAKKLEAETKESIHDDRLYLYYLQEGRDMYTGKEIPFDQISSNYDIDHIIPQAFTKDDSLDNRVLVNRATNARKSNSPTFTNDIIDNRKSWWQSLVKRGLMSKEKFERLTDKRKTFSENQTNHFIARQLVETRQIIKNVADLIKNNYDGTQAVAIRASLTGEMRRYLDWPKNRDMNDYHHAHDALMMATVGKYVDRRGFFDNGSVSDGAGNAYNLYTKDWLVAARVGTRNDSQRVNPYGFIVGSMNSKAVRQQVNKETGEIVWGNENLDYLRHVLSYKKILVTRRLSGSSGRLYAETLFSPNPKAKLIAQKANRSVALYGGFTKAESAYTALVEFNKKGDRSYKLIKVPMAIANRVNDKQITVTAYIASLNLRDFSRVVLEHLPLGTLIRESDGSEFYAASSEYKHNAKELWAPKEILRSSKKLDKATADNLIDIFDFLTNDKTISNFKFYEKDLLHLKNVRDKFVEASDEIKIKVLSDVIYELHNDAGWRDPFKHIQEKPAWTMLQVKGGIKLSEKAAIVYQSPTGLFETITIVGE

SEQ ID NO: 1054 - protein, 883 aa, Leuconostoc pseudomesenteroides
MIGVRLFEGADTAAERRGYRTTRRRLSRRRWRLRLLNDIFASELSKIDENFLPRLKYSWVNKNDTDNVHFGVGVFDNSEQEKAFYQDYPTIYHLRQKLMTDNRQHDLREVYLAIHHIVKYRGHFLNSGEISANSSFDAQKFLELLREFDNTFYPDAVKFLNLDQLDLPDKISSEISDSKISKSERVDRVLQHVQLANSGAKKILKAILNAVVGNSVDSVAMFSLSDLDKEEKKKINHPVTDSKPFKYSDKEVEAKLDELSNLLQDEQKIEFLSLLKLSFDGLTLKMLLGNAKSVSEAMVERYKVHKDDLKFIKENILNSFSKDKKKEFDKYYEAHLAEKDVDNVDKYFKKIIDDSIISKDKKIELLQKIDDHDFLPSQRSKINGAIPHQLHRNELDKIISQQSKYYPFLADSYTQNGKTETKLAGLVNFRVPYYVGPLVSKENADRNNPDGGQNHWVEFKENTSLSNLTPWNFNEIVDKDKSAAKFIERLTGMDTYLIGEPTLPQNSLLYQKYNVLQELNNIRVDNHKLDVKIKQDVFEHLFKTQNSVSAKDVKNYLIANGYAAPSIQITGLSDTNEKTFNSKLSSYNYLVDKLGRTFVESVKSDVLEKIIELQTVFEDKTVLLRQLSMISELTLAQANQLAEKHWTGWGRLSRKLLSSKVVDVNKITNSTFYPATSRQTIIDTLYHTQLNLMEIINNAEDLYGVRQWISEQNKSDSSDTNDVYDQIQELAGDKKIKRGITQSFRILDDIVKAMGGEPERVYLEFARENQQSGVSFSRKNLLSKLYENDSLKQTFKELKSQLESETKENLQNDRLYLYYLQQGRDMYSNDELNIDQLSSYDIDHIIPQAYTKDNSFDNRVLVSSKANRLKRMLLWYPVKLSKK

SEQ ID NO: 1055 - protein, 468 aa, Leuconostoc pseudomesenteroides
MKDQGFISKRKFENLTRRGDFSEQQKERFIARALVETRQIIVNVSSLIDSHFNHTKAVAVKSNMTTDMRHYTKVPKNRDINDYHHAHDALFVATVGQYIENKGFMKAGKLSDSVGNEYNRYTKKWIETARKNTNYGRVNPFGFVVGSMQTATRGKLDYETGELKVVKNNYWSKDDLDYLLKVVSYKKILVTTKLQDNKGAMYDANLISAKGSGKKKAQLQISKSKNIDLYGGFNKLQNEYSVLILNHDEYRWLSIPMYARNSSEQYLHDKYPDAKVILNHILVGQPILLSNSSDPQKSKFASLRIATGGDYHNNFEFVPSVDVKKILDNIYLNHSVTDDEYKKVFESLLATLHDKFVFGIHQVMYNKIFDNKYLFDKMPDEAKRNVINSLLKFMNISKNQLGAVGKIGGKVNGVLYGFKTETEKGTSAGQLISNGKMQPHDIFIFQSPTGIFERRVTVAELANVIKDE

SEQ ID NO: 1056 - protein, 1103 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 1057 - protein, 1337 aa, Listeria innocua
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 1058 - protein, 953 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 1059 - protein, 232 aa, Listeria ivanovii
MMSKLILGLDIGISSVGWGVLDESTNEVVDAGVRLFEEATRNGNEDRRGFRSARRLKRRRQHRLERAKGLIENNGFSCTDINKFNPYQARYNAIFGEVTKDELAAALFHLVKRRGTTIDAPEEEVKDVENELSTKMQLEKNAKKLATKYDYICEIQLEKLKENKVVRDHENRFRTEDYVKEARAILENQQEYYPEVTNEFIESYMALIETRRMYYDGPGSEKSPTPYGQYFI

SEQ ID NO: 1060 - protein, 300 aa, Listeria monocytogenes
DDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHD

SEQ ID NO: 1061 - protein, 782 aa, Listeria monocytogenes
  misc_feature (722)..(722): Xaa can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 1062 - protein, 1334 aa, Listeria monocytogenes; identical to SEQ ID NO: 109

SEQ ID NO: 1063 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 1064 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 1065 - protein, 1099 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGIPAN

SEQ ID NO: 1066 - protein, 1334 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 1067 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 1068 - protein, 874 aa, Listeria seeligeri; identical to SEQ ID NO: 175

SEQ ID NO: 1069 - protein, 1087 aa, Unknown
  Listeriaceae bacterium
MKKLVLGLDIGVASVGWGIIDAENGDVVDTGVRLFSSRDASENESRRTSRQSRRLSRRKKHRRERIKQLLLAHDMDICDIVNENPYELRVKGLNEKLEVSEIYVALTHLAKRRGVSYLDDVVEEGGTIKSEHLNKNMEEIKSGKMPCEIQLERFEKYGQVRGMIEINQDTEESSFLVNIFRTSDYIKEAKTILATQQKFHKQITNEFIDEYIHIMASKRDYFIGPGNEKSRTDYGVYRTNGDTWDNLFEILIGKCSVFPEETRAARSSYVAQEFNLLNDLNNLKISNLESGKLSASQKHDIVEKVKNSKKFGTKDLLKYIASVCECKIEDIGGCRVDKNRKPIMHTFENYRKVHNALNEAGVDLRLSETDYDELMKIMTLNSETLEIKKQCKEKLPQLTEDYLNVCLVLNKKGAFSGWHALSLKAMKLMMPELYGTSKNQMQIIHTMQLGKAYLKPLNQQKYLNSEAILEEIYNPIAARSIRQTIKVTNAILKKYGHLDSVIIEMPRDYQTSEDERKMIEKMQKENEKEKKAALKRAREEYPFPDEAFRNHKELATKLRLWYQQDQFCVYSGRKISVVDLVRNPNQFEIDHIIPQSVSLDDSLNNKVLCFSEENQKKGQQTPFYYHKGKSGNWTYEQYKLFVEKLFDKKKISNKKRELLLFEEDINKWDVRRGFIARNLVDTRYASRVILNSYQQYFGNHEMGTKVKVVRGKFTSQLRKKWRIFKDRNESHSHHAIDALIVAATANLRLWKKNTLGVSDEGKVYDKETGEILPFEKLTESEYNEMMNKEPYLNFKTKLQNIETKVKYSYRVSKKVNRKISDATIYSTRERDGIDYIVGKIKNIYDVKTYKDQFLKRYKKNKEQFLMYQHDPQTFAILENIMATYQDAENPFLAYKKEYGVIRKYSKKGGGSPVTSLKFIDKVLGQKIDLTAKNQAALPKNKKVVLQSITPYRADVYYDEIDKRYHLIGVKYSLFSFSKQGYVINPIAYQKLLEKEQIHSEMKFCFSLYREDIIEFGEDPDSLTRYRFWSKNESGKNKIEVKPIEKPNFEKQTVLTITKKIKILNKYQTDVLGNSFKAQEEKDPRNIE

SEQ ID NO: 1070 - protein, 1345 aa, Unknown
  Marinilabilia sp. AK2
MKKILGLDLGTTSIGWAFIKEPEKDVVGSEIVDMGVRIVALSSDEENDFAKGNTISINADRTLKRGARRNLQRFKLRRDALLEIFKEMKLIPSNFKYAEDGPSSTFSTLKLRDKAAKEKIELDDLVKVLLQINKKRGYRSSRKAKSEEDDGSAIDSMGIAKELYENDLTPGQWVFEALQKGRKNVPDFYRSDLQEEFKKIVNYQSEFYPDVLNSSFVEDWMGKASTPTKQYFNKKGVHLAENKGKREERRLQEYNWRAVAVNSKIDLSEIALILSQINSQISNSSGYLGAISDRSKELYFKNQTVGQYLYQQIKINPHTRLKGQVFYRQDYLDEFEKIWSVQSGFHPQLNDALKKEIRDITIFFQRRLKSQKHLISNCEFEDYHKVVPKSHPIFQEFRIWQNLNNLTLIKKDNLNEKSELALEDKIALANELAFKREQSVKDALNILGLKSSEWEFNFTKIEGNRTNHAFFEAFAKIIEIEDGEPLDLGNLKADDILDQFSEAFLRIGIDPGLLQVNNDIEGPNYEKQPYIQFWHLLYSSEDDQKLKQNLIKKFGFKPDHAKILASISLQDDHASLSSRAIKKILPHLQSGLIYDKACTYAGYNHSSSFTKEENEKRELSSELDLLKKNSLRNPVVEKILNQMINVVNAILKDPNLGKPDEIRVEMARELKANAEQRKNMTSNIASATRDHEKYREILKKEFGLKRVTKNDLLRYKLWLETDGISLYTGKPIEASKLFSKEYDIEHIIPKTRLFDDSFSNKTICERQLNIDKANVTAFSFLQNKLSGDEFEQYQSRVKSLFGKLSKAKIQKLLMANDKIPEDFIARQLQETRYISKKAKEILFEITRRVSVTTGTITDKLREDWGLVEIMKELNWEKYDKLGLTYTIEGKHGERLNKIKDWSKRNDHRHHAMDALTVALTKPAYIQYLNNLNAKELNGKKSTEIFAIEQKYLKRENGKLCFIPPVENIRTEAKKHLSKVLISYKAKNKVVTINKNRTNKKAGFNEQIALTPRGQLHKETVYGKAFHYSTKFEKIGASFDVQKINAVAKKEEREALLKRLAENGDDPKKAFTGKNSLSKMPIYLDLKRNIKLPEKVKTVVLEQNYTIRKNIDPDLKLDKVIDVGVKRILENRLKEFGGNAKLALSNLDENPIWLNKEKGITIKRVKISGVSNVESLHVKKDHFGEPILDQVGNEIPVDFVSTGNNHHVAIYEDEKGNLQEEVVSFFEAVVRQNQGLPIINKNHSLGWKFLFTLKQNEYFVFPSDDFDPTDVDLMDEENYHLISPNLFRVQKFTTKDYFFRHHLETTVEDKSELKGVSFKRLGLPGLNCIKKIRINHLGKIIQVGEY

SEQ ID NO: 1071 - protein, 1091 aa, Mobiluncus mulieris
MDSRKYRVGIDVGTNSVGFAAVEEDDSGSPTRFLNTMVVIHDSGVDSEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 1072 - protein, 1233 aa, Mycoplasma canis
MEKKRKVTLGFDLGIASIGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTNANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNELLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISTNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNPDTSKTPKRLMFGIKSIMNNYEQVDISPFGINKKIFE

SEQ ID NO: 1073 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTIESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTSANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDAILPKLLDNNEGWNLEAIKNYDEEIKSQIEDNSFLMAKQDKKYLNDNFLKDAILPPNVKVTFQQAILIFNKIIQKFSKDFEIDKVVIELAREMTQDQENDALKGIAKAQKSKKSLVEERLEANNIDKSVFNEKYEKLIYKIFLWISQDFKDPYTGAKISANEIVDNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDDKKMFKVIAMNGAVTSFIRKNMSYDNKLRLKNRNDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKLSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 1074 - protein, 1233 aa, Mycoplasma canis; identical to SEQ ID NO: 242

SEQ ID NO: 1075 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEENAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKSHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGMAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDKFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 1076 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMLSVEDIDMIKYEWAGKEPNVYGVGLSGLNIEESAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFDDKYEKLIYKIFLWISQDFKDPYTGAKISANEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 1077 - protein, 1239 aa, Mycoplasma cynos
MEEKRKVTLGFDLGVASVGWAIVDSETNEVYKLGSRLFDIPDTNIDRRAKRGSRRLVRRRSYRNQKFYNLIKRTKTFGFLDKEAIEKEFVLLSIKYPNIIELKVKGLQEEVSKSEAVWILHDYLKNRGYFYDDKEEKDDLENPSIESMPSYKLYEFYKEYGYFKGALSSPTESEKNKDSDLEKAIFFNFSNKEWTKEINHFFKIQKNIFSEDFKAKFMEFFSFIRDISKGPGSENMPSQYSIFGKYGDDGMGGKYQHIWDKNIGKCSIFKDKVRAPKYLPSALFFNLLNELSNIRLYSVDKREKSVLWRLSSKDKINIILNILQIILFKNDGKISNLDINKIVKNESIKSIILNEIDLDLIKDMWFEKEPNVYGIGLSGLNIEENKKENRFKFQDLKIFSVFIDLLKKSNINIEFNNEKDIIHNLKLLDELYFFLITQKYSRDKYGSIKKFILNNKSFNIDNLDEKLNIFLSISDDEFDNHNSKTHSLSKEAIYFIFPKLLHNNEGWNLEAIKNYDIDVREEISKHSFGIKKQDKKYLDDAFLDDAILPPSVKVTIKQSILIFNKIIKKFSNKFQIDNVVIELAREMTQEKEMDAQKSLNRLKKSRKKIIEERLNANNIDSKMFRDKTGEISPNYIYKIYLWISQNFKDPYTGENISANDILKNNVEIDHIIPYSLCFDDSSSNKVLVFKHSNQSKGNFLPFDMISTFSENSVWNWKEYTQYVEKTFKTNLESILDKKERVKKADNLLTSSYDGYDKLGFLARNLNDTRYATILFRDQLINYSENHLIDSKKMFKVIAMNGGVTSFIRKNMSFDSGLKVKDRSIFSHHAYDAAIIALFSNKTKILYNLINPSLDGIISKRSEGYWVLEDRLTGEIRKLNYNDWQSIKNNVEVKKIAREIESHLSNLDNVVMFSRKSKRKTNKELYNETLYGIATRIDENGIKNYYKKEKFNILEDENIYLRLLNERENFIINRSNPEVIDAIIEIFETIDKNKIPARDVAKNIKYTDNKIKYNLYLKDYMRKLVDEFPDKFRKDFIEQMIAKKIFILFNPIKNTTRKIKSLRSINNNKIEDIRKKQVLEKFNTAKNEPRSFYESLNSLGAIIFKNNLNIYKKMSISSQIATFGDKNWKIDDINTYNKEKLNKYKEIYGIDETYDFYSFIFPGTILLDEKNKEFLYISSIQTLKDKIELKFLDRIEFEKKNVNSNLKPKIKREIISTKKLMSDYKIIKISPLGINKKIFE

SEQ ID NO: 1078 - protein, 1269 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKKKKANRFLMTLSTILNDYILLDAKDNFDILGLSKNRIDEILNSKLGLDKITK

SEQ ID NO: 1079 - protein, 1224 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKRRKQIGS

SEQ ID NO: 1080 - protein, 1269 aa, Mycoplasma gallisepticum; identical to SEQ ID NO: 133

SEQ ID NO: 1081 - protein, 226 aa, Mycoplasma iowae
MSNKKKITIGLDIGVSSVGWSILREDNVLIDYGSRLFPDAANAKDGKLENEARRSHRSMRRRIRRIKTRKNDLIKLLIKYNIISDQDELAKILEQGIVNETGNVPIVEIKYKGLKEKLSKEELLICLYHYIHKRGYFYITEEDLKENGENINRLPTEIQYDFYMKNGYYIGNEDNQKFSNLIWVKEIEKFLSKQSLDSNFVDEYISLFRRVRDYSDGPGSEKSPTP

SEQ ID NO: 1082 - protein, 1304 aa, Mycoplasma synoviae
MLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 1083 - protein, 1401 aa, Myroides injenensis
MKRILGLDLGTTSIGWAYVHEAENVNETSSIQKVGVRVNPLTTEEQTNFEKGKPITTNASRTLARSARRNLQRYKLRRDNLIQILKENNWINNTTSLTETGNHSTFETYELRNKAASEKLTLDQLSRVLLMLNKKRGYKSSRKVNSKEEGQLIDGMEVAKKLYHEQLTPGQLSLQLMNQGVKKLPDYYRSDLNQELESIWNFQQQFYPNILTDKFKEEINGKGLTSTSSAFWNIYNFNTAENKGSRDEKKKQALQWRSEALSKQLSKEIVAYIIADLNGQIYNSSGYLGAISDRSKELYFNNLTVGQYLFKQLKSNPHTSLKNQVFYRQDYLNEFEKIWETQSKFYPKELTAALKREIRDVIIFYQRKLKSQKGLISFCEFEQKQKTINGKTKTIGHRVIPKSSPLFQEFKIWQQLHNVVLRNKKTNEIVSLADEQKVHLFEELNLKGKLKSNQVLKLIENKPKDWELNYTELEGNNTNKALYNAYLDILDIEGYDVRNELKVKLNKDDIELSDLDVNASEIKEMIFSVFKHLGINTEILEFDATLEDKVFEKQASYQLWHLLYSYEEDNSPTGLDRLYNLLHKKFGFKLNHAKLIGNVLFQDDYGSLSSKAIKNIFPYITENNYYTACELAGYKHSKHSLTKEENETRELKNRLTILPKNSLRNPVVEKIINQMINVVNTLIDEENNILIAQGKEPNFQFDEIRIELARELKKNAKEREELTKSINKSKTDHEKIIKILQKEDGIKNPTRNDIVRFKLYSELKNNGYKDLYTNEYIERKDIFTKEYDIEHIIPQSKLFDDSFSNKTLVRRNVNLKKGNQTAYDFILCEYGQEKANEFETRITNLYNLGKDEGISKSKFKKLLMQESEIGNGFIERDLRETQYIAKKAKSLLLEITRNVISTSGSITDRLREDWGLINVMKELNLQKYRDAGLTEFVKMKDGNKKEVIIDWTKRNDHRHHAMDALTIAFTKHNHIQYLNHLNARKNVNNELHNNIIAIEKLETTLVSDERGNKKRIFKEPIANFRTIAKSHLEAILVSHKAKNKVVTKNINKISGKKISQQTLTPRGQLHKETIYGKIRQYVSKQEKVGPKFTIEVIEQVSNPTYRNLLLKRLEENNNDPKKAFGGKNSLNKNPIYINLEKNIKVPEVLKLVWLEDNYTIRKEISPDLKIDKVIDQGVKQILQNRLAQYKGDSKLAFSNLDANPIWLNEDKGIAIKRVTISGIATAQPLHRKKDHLGQPILDHNGQEIPVDFISTGNNHHVAIYEDENGKLQESVVSHFEAVERVNQKLPIIDKTFNQHLGWKFLFTMKQNELFLFPSDDFNPNEIDLFDKQNYTVISKHLFRIQKLSTKDYSFRHHLETNVEEIKDLKTITWRREGLNGIQNIIKVRTNHLGEIIHIGEY

SEQ ID NO: 1084 - protein, 1466 aa, Myroides odoratus
MKNILGLDLGTNSIGWALVKEDFENKQGEILGLGSRIIPMSQDILGEFGRGNSISQTADRTGYRGVRRLRERHLLRRERLHRVLNILGFLPNHYAKEIDFTKRLGKFINHAEPKLSFDKEFIFKDSFNEMLKDFQQNQPGFIINKHGEEALVPYDWTIYYLRKKALTQKIDKEELAWILLNFNQKRGYYQLRGEEEEENTNKLVEFYSLKIIDVIADNEVNKKGEVWYSLHLENGWIYRRSSKISLVDWKDKVRDFIVTTDVNDDGSEKLDKDGVVKRSFRAPSADDWTLLKKKTEQDIDNSNKTVGAYIYENLLLNPKQKIKGKLVRTIERKFYKDELKQILEKQKEFHQELQNEQLLQDCVRELYKYNEQHQQMLESKDFVHLFLNDIIFYQRPLRSQKSLISNCTLEKRVSRDGVVFPIKVISKSNPYYQEFRLLQWLQNLAIYRKDDDVNVTQEFLNSIESWENLLQFLNAKKEIKQEQLIKFLLEQKGLKGNSLKTAILTYRWNYVTDKVYPMNETRSLIQDKLKKVENVATDFLSFDNEMALWHIIYSVNDKIEYEKALAKFASKHNLDEISFVESFKKFPPFKSDYGSFSEKAIKKLLPLMRFGSVWNKNNIVPSVLDRIDKILTGEYDEKIKIRVREKAEQFQLNQIEDFQNLPLWLAQYVVYDRHSEAEIAGKWNSVKDLENYLKEFKQHSLRNPIVEQIITETLRVVKDIWQQYGNGVQNFFDEIHIELGREMKNTADERKRITNSVTENENTNLRIKALLVELKEDTNIENVRPHSPMQQEILKIYEEGVLNAVENIDEDILKISKTAQPSKSELIRYKLWLEQKYQSPYTGEMIPLSRLFTSDYEIEHVIPQSRYFDDSLSNKVICEAAVNKRKDNQLGLEFIKNHHSEKIELGNGRTAQVLEVEAYESFVKKNYDKNRGKRNKLLLEDVPEKMIERQLNDTRYISKFVTHLLSNIVRKDEVNSKDDGINSKNIIPGNGKITSQLKQDWGLNDVWNELILPRFERMNNLTNSTDFTSTNTNGKIIPTVPLEYSKGFSKKRIDHRHHALDALVIALATRDHVNLLNNESALPKKDRTKEEQKSFRFDLQVNLRNKEKYFNVKEGREKEKFTTFKKPWNTLTQDTRDALENMVVSFKQNLRVINKATNYYESYTDENGNLRLDKYGNPKKELISQKGTNWAIRKSLHKETVSGQIHLDRVKVTKGKIVTATRKSLDSSFNEKSIESITDTGIQKILRNYLKAKDNKPDVAFSPEGIEELNKSISVYNEGKNHQPIIKVRIFEQGSKFPVGETGNKIAKFVEAAKGTNLFFGIYQDKTGKRSYDTIPLNLVIERLKQGLSPVPETNEKGHQLLFHLSPNDLVYVPTIDDNEQLDSNRVYKFTDSSDTTCNFIPSNISAIIFNINSKEQEKRGINYPIQNELGVGSPQSKNQKSFDGFMIKEVCIKLKVDRLGNISKT

SEQ ID NO: 1085 - protein, 241 aa, Neisseria lactamica
MAAFKPNPMNYILGLDIGIASVGWAMVEIDKEENPIRLIDLGVRVFERAEMPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHVSDGLKEGIETLLMA

SEQ ID NO: 1086 - protein, 666 aa, Neisseria lactamica
MAAFKPNPMNYILGLDIGIASVGWAMVEVDEEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLVKHRGYLSQRKNEGETADKELGALLKGVADNAHALQTGDFRTPAELALNKFEKESGHIRNQRGDYSHTFSRKDLQAELNLLFEKQKEFGNPHVSDGLKEDIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKNNGFCCKNSMKKDLKNAT

SEQ ID NO: 1087 - protein, 828 aa, Neisseria lactamica
MLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYGKKNTEEKIYLPPIPADEIRNPVVLRALSQARKVINAVVRRYDSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTSEKLRTLLAEKLSSRPEAVHEYVTPLFVSRAPNRKMSGQGHMETVKSAKRLDEGISVLRVPLTQLKLKDLEKMVNREREPKLYDALKAQLETHKDDPAKAFAEPFYKYDKAGSRTQQVKAVRIEQVQKTGVWVRNHNGIADNATMVRVDVFEKGGKYYLVPIYSWQVAKGILPDRAVVAFKDEEDWTVMDDSFEFRFVLYANDLIKAELKKETFFGYFSGLDRSTGNISLRSHDLDKTKGKDGVYRIGIKTALSFQKHQIDELGKEIRPCRLKKRPPVR

SEQ ID NO: 1088 - protein, 408 aa, Neisseria lactamica
MNDTRYVNRFLCQFVADHILLTGKGKRRVFASNGQITNLLRGFWGLRKVRTENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDDPAKAFAEPFYKYDKAGSRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKTKSTNSAKKSDHAV

SEQ ID NO: 1089 - protein, 1082 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 1090 - protein, 976 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGIFAG

SEQ ID NO: 1091 - protein, 1081 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVADNAHALQTGDFRTPAELALNKFEKESGHIRNRRGDYSHTFSRKDLQAELDLLFEKQKEFGNPHISDDLKEGIETLLMTQRPALSGDAVQKMLGHCTFEPTEPKAAKNTYTAERFVWLTKLNNLRILEQGSERPLTDTERATLMDEPYRKSKLTYAQARKLLELDDTAFFKGLRYGKDNAEASTLMEMKAYHAISRALEKEGLKDKKSPLNLSPELQDEIGTAFSLFKTDEDITGRLKDRVQPEILEVLLKHISFDKFVQISLKALRRIVPLMEQGKRYDEACAEIYGDHDGKKNTEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENNRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 1092 - protein, 1081 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 1093 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGEEIRPCRLKKRPPVR

SEQ ID NO: 1094 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 1095 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLYQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 1096 - protein, 1081 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAKLALNKFEKESGHIRNQRGDYSHTFSRKDLQAELNLLFEKQKEFGNPHISDGLKEGIETLLMTQRPALSGDAVQKMLGHCTFEPTEPKAAKNTYTAERFVWLTKLNNLRILEQGSEQPLTDTQRAKLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYNEACAEIYGDHYGKKNTEEKIYLPPIPADEIRNPVVLRALSQARKVINGVVRRYGSPARIHIETAREVGKSFKDRKEIEKRQEENRKDREKAAAKFQEYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 1097 - protein, 1081 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLSLEDTAFFKGLRYGKDNAEASTLMEMKAYHTISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 1098 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGGKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 1099 - protein, 1081 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEEIYLPPITADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKENSREWQEFKARVETSRFPRSKKQRILLQKFDEDGFKERNLNDTRYVNRFLCQFVADRMRLTGKGKKRVFASNGQITNLLRGFWGLHKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKDLEKMVNRAREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 1100 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADKIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 1101 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 1102 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTLWQLRAAALDRKLTPLEWSAVLLHLIKHRGYLSQRKNEGETADKELGALLKGVAGNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPTEPKAAKNTYTTERFIWLTKLNNLRILEQGSERPLTDTERATLMDEPYRKSKLTYAQARKLLELDDIAFFKGLRYGKDNAEASTLMEMKAYHAISRALEKEGLKDKKSPLNLSPELQDEIGTAFSLFKTDEDITGRLKDRIQPEILEALLKHINFDKFVQISLKALRRIVPLMEQGKRYDEACAEIYGDHYGKKNTEEKIDLPPIPADEIHNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLTEKLSSRPEAVHEYVTPLFVSRAPNRKMSGQGHMETVKSAKRLDEGISVLRVPLTQLKLKDLEKMVNREREPKLYEALKARLEAHKDDPAKAFAEPFYKYDKAGNRTQQVKAMRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 1103 - protein, 1082 aa, Neisseria meningitidis
MAAFKPNPINYILGLDIGIASVGWAMVEIDEEENPIRLIDLSVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFVWLTKLNNLRILEQGSERPLTDTERATLMDEPYRKSKLTYAQARKLLGLEDTAFFKGLRYGKDNAEASTLMEMKAYHAISRALEKEGLKDKKSPLRLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 1104 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 1105 - protein, 67 aa, Neisseria meningitidis
MFGYFASCHRGTGNINIRIHDLDHKIGKNGILEGIGVKTALSFQKYQIDELGKEIRPCRLKKRPPVR

SEQ ID NO: 1106 - protein, 220 aa, Neisseria mucosa
MRHIFSDGLKEGIETLLMTQRPALSGDAVQKMLGHCTFEPTEPKAAKNTYTAERFIWLTKLNNLRILEQGSERPLTNTERATLMDEPYRKSKLTYAQARKLLGLKDTAFFKGLRYGKDNAEASTLMEMKAYHAISRALEKEGLKDKKSPLNLSPELQDEIGTAFSLFKTDEDITGRLKTELTPASNKTLSRPFTVKSASNGSTSAPWLPSTKWFLHFKPA

SEQ ID NO: 1107 - protein, 392 aa, Unknown
  Neisseria sp. oral taxon 020 str. F0370
MAPFTLKPLNYILGLDIGIASVGWAVVETDSDVLPYRLIDVGVRTFDRAEVPKTGESPAAARRLARSVRRMIRRRAHRMLRARRLLKREGMLQAADFDAHGLVENLPVNPWQLRVDALSRKLMPLEWAAVLLHMVKHRGYLSQRKNERNSSDKELGALLSGVAANSEALQGGDFRTPAELAVNKFEKESGHIRNQRGDYSHTFNRKDVQAELVLLFEKQKEYGNPYISDGLLTGVEDLLMTQRAALSGDAVQKMLGRCTFEPEEYKAAKNTYSAERFVWLTKLNNLRILDQGSERPLTDSERAKLMDEPYKKTKLTYAQVRRLLELDDTAFFKGLRYSKDNAESATLMEMKAYHSISGALEKAGLKNKKIAAGLIARIAGRNRRGVFAIQNR

SEQ ID NO: 1108 - protein, 701 aa, Unknown
  Neisseria sp. oral taxon 20 str. F0370
MQDEIGEAFSLFKTDEDIRGRLKGKLPDEQLDALLEYVSFDKFVQLSLKALRKILPLMEQGKRYDEACAEIYGDHYGIKDDKQAQFLPPVSADEIRNPVVLRALSQARKVVNAVVRRYGSPARVHIETAREVGKSFLDRKKIEKRQEENRKDRERSIAKFREYFPNFVGEPKAKDILKMRLYEQQQGQCLYSGKAIDLRRLNEKGYVEIDHALPFSRTWDDSFNNKVLVLAGENQNKRNQTPFEWLGGDEKRWREFTARVEHCRFPRSKKQRILMQKLDEKDFKERNLNDTRYVNRFLCNFIAQNMLLTGEDKNRVFASNGQITNLLRGMWGLKKVRESNDRHHALDAVVVACSTVAMQQKITNYVRQKEMNVFDGEMVDKTTGEVSRLHFPQPWDFFRQEVMMRVFGKPDTPSENNEEADTPEKLRALLADKLSSRPEAVHEAVTPLFVSRAPSRKMSGQGHMETIKSAKRLSEGKSVLRVPLTQLTPKLLENMVNREREPQLYEDLLGRLNAHGGDPAKAFAAPFFKRDKAGNPTQQVKAVRVEDVQKSGVIVREGNGVADNATMVRVDVFEKGGKYYLMPIYTWQAAKGILPNKAVIAHTDEANWQEMDTSFTFKFALYPNDLVLASLKKETYFGYFAGLDRSTGNISLRVHDLEKSKGKDGVYRIGVKTALSFQKYQVDELGKTIRPCRLKKRPPVR

SEQ ID NO: 1109 - protein, 1089 aa, Unknown
  Neisseria sp. oral taxon 014 str. F0314
MTAFKPNPLNYILGLDIGIASVGWAMVEIDDKENPVRLIDLGVRVFERAEMPKTGDSLAAARRLARSVRRLTRRRAHRLLRARRLLKHEGVLKPEDFDENGLVKPLPYIPKQPRNTPWQLRAAALDRKLTPLEWAAVLLHLVKHRGYLSQRKNEGETDDKELGALLKGVADNTHALQAGNFRTPAELALNKFEKESGHIRNQRGDYSHTFSRKDLQAELVLLFEKQKEFGNPYVSDDLKNGIENLLMTQRPALSGDAIQKMLGHCTFEPAEPKAAKNTYTAERFIWLTKLNNLRILNQGNERPLTDAERTTLMDEPYKKSKLTYAQARKLLDLDDTAFFKGLRYGKDNAESATLMEMKAYHAISRALEKEGLKDKKSPLSLSPELQDEIGTAFSLFKTDEEITGRLKGCLQPEILDALLKHISFDKFVQISLKALRRIVPLMEQGKRYDEACAEIYGDHHGRRNSEETLYLPPIPADEIRNPVVLRALSQARKVINGVGRRYGSPARIHIETAREVGKSFKDRKEIEKRQEENRKDREKAAAEFQEYFPNFVGEPKSKDILKLRLYRQQNCKCLYSGKEINLGRLNEKGYVEIDHALPFSRTWDDSFNNKVLVLGSENQNKGNRTPYEYLNGKDNSREWQEFKARVETSRFPHSKKQRILLQKFDEEGFKERNLNDTRYVNRFLCKFVADHMQLTGKGKRRVFASNGQITNLLRGFWGLRKVRAENDRHHALDAVVVACSTVAMQQRITRFVRYKEMNAFDGKTVDKETGEVLHQKTHFPQPWEFFAQEVMIRVFGKPDGKPELEEADTPEKLRALLAEKLSSRPEAVHEYVAPLFVSRAPNRKMSGQGHMETIKSPKRLDEGISVVRVPLTQLKLKDLEKMVNREREPKLYEALKARLEAHKDDPAKAFAEPFYKQDKAGNRTQQVKAVRIEQVQKTGVWVRNQNGIADNATMVRVDVFEKGGKYYLVPIYSWQVAKGILPDKAIIAFKDEEEWQLIDDSFNFKFPLHPNDLVEVITKKARIFGYFASCHRGTGNINIRIHDLDNKVGKNGILEGIGVKTALSFQKYQIDELGKEIRPCRLKKRPPVR

SEQ ID NO: 1110 - protein, 1097 aa, Neisseria wadsworthii
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGHLRNKGGEYTHTFNRLDLQKELHLLFERQYALGNPFASAELQSKVDELLMTQRSALQGEAVLKMLGKCTFEPSEYKAAKNTYSAERFIWLTKLNNLRILYNGEERALDEGDRKKLLDEPYKKAKLTYKQVRSILNLPESAVFKGLRYGKDSDGLKAENGTLMEMKAYHKIRTILDKAGLKGEWENRIRNPEILDKIGTAFSLYKTDEDIQAALADLRLPENVLDALLAGLNFDKFIQLSLKALRNILPLMERGIRYDEACKEVYGDHRALAESKNQVLLPPIPADEIRNPVVLRTLTQARKVINAIIRRYGSPQRVHIETARELGKSKQERDKIDRKNKENQNDRNRLASDIRKHFNFEPTPKDILKLRLYEQQHGKCLYSDLREEKGECLYTGNVIELHRLFEDGYVEIDHALPLSRTWDNSLNNKVLVLKSSNQNKGNKTPYEWLDGANNSRRWREFQARVQGCHFPYVKKQRIQTAKLDSKAEQGFLERNLNDTRYISKFMCQFITANLRLAETSNALMEEVAGENPYWKERKRQRVFAPSGSIIALLRGLWGLKKVREDNDRHHALDAIVVACSTVSMQQKITKAMQRRETLETVDSETGEVKTRIPQPWDFFRQEVMIRVFSDSPREELAEKLNSRPEALHDFVSPLFVSRAPNRKMTGQGHLETVKSAKRLSENISVVRKPLTALKLKDIENIVGYPDREPALYQALRERLLAHKDDPVKAFADKPFYKPAKDGGQGSLVKAVRIIENTKHGLKIRNGITDTNGDMVRTDVYQKTDKKGKRQYFIVPVYAWQVEKNELPTVDCKGYEIDDNYEFCFSLYKYDLIEIQNPNDINQELRAYYINCDSSDGRFWLAYHDKSAKEQQFRISTQNQPIIKKYQVDTLGKEIRLCKAEKRTALNGKKKK

SEQ ID NO: 1111 - protein, 1426 aa, Niabella soli
MPRKNILGLDLGTTSIGFAKIIEDDDYQCSSVELIGVRVNPLTTDEQTNFEKGKPVSVNADRTLKRGMRRNLDRYQLRRDYLIEILRTHHIITADTKLAEDGKNTTHTTYALRALAATAEIPLEAFVRVLLAINKKRGYKSSRKAKNEDEGQLIDGMAIARRLYEESLTPGQFSYQLLKEGKKYLPDFYRSDLNTELNKVWNFQKQFYPEILTDEFKRHLEGKGQRATAVAFWGQHGFSMAENKGSREEKKLHAYKWRSEAAHKQLTKEEVAFVITEINNDLNKSSGYLGAISDRSKELFFNKQTVGQYLHQQLKENPHTRLKGQVFYRQDYLDEFETIWEMQAKFYSALTLELKEEVRDVVIFYQRKLKSQMGLISLCEFESKEIEIEKNGEKAKKRIGLRVAPKSSPLFQEFKIWQVLNNLEFRNKKTKEVFVPEMAAKQQLFDELNIKGNLLASEAIKILGYKTKDWEANYHTLEGNRTNKSLYDAWLKILELEGYDENLLKLSGSDDIDVSKIEKPALEIRQMVLAVFEVLGISGAILDFDAEADGKAFEQQPAYQLWHLLYSAEDDGKKYSQEDIFTYGHDNIGLKKKLCEKFGFRPEHTKILVNVVFSDDYGNLSSKAMRRIYPFIKELTYDKACAEAGYRHSAASLTKEEIAARPLQNRLDLLKKNELRSPVVEKILNQMVNVVNTLVDDENQNRKARGLSEDFHFDEIRIELARELKKNAKERAEMTTNINTAKQSHEKIIRILQTEFGVPNPSRNDIVRYKLYEELKNNGYKDLYTNTYISRDILFSKQIDVDHIIPQMSLFDDSFSNKTVVFRKDNQDKGNKTAYDYILGKYGEQALEEYISRITSLFELGKKNKEEGIGKAKFQKLQKRLVDIGDGFIERDLRESQYIAKKANNMLYAICRSVVSTSGEITARLREDWDLVNVMQEINLPKFRALGLTEMVEKKDGAQKERITDWTKRNDHRHHAMDALAIAFTRHSHIQYLNHLNARKDEANKWHPVVSKIEEKETVLIYDDLGNRKRKFKAPMPNFREVVKEHLENVLISHKAKNKVVTKNKNKIKTVRGEKVKTELTPRGQLHKETIYGRYRYYESKEEKIGPKFDAEMIGMVTNPQYKKLLLERLAANGNDPKKAFWGKNALNKNPLYVDEARQELLPEKILLRWLNDDYSIRKDVTPENLKDIKTIEKILDKGVKKILLKRLADFGNDPKKAFSDLDKNPIWQNEAKRIAIKRVTISGIKNAAPLHHKKDHLGNDILDEKGKQIPSSFVSTGNNHHVAIYRDAEGNLQERVVSLFDAVQLVNGGEPVIDKEYNKGIGWQFLFTMKQNEMFVFPDEKTGFNPREVDLLSSGNRKLISPNLFRVQKLASKNYFFRHHLETSVEEKKELKNIAYKPQLGLNALSNIVKVRINHIGEIVSVGEY

SEQ ID NO: 1112 - protein, 79 aa, Nitritalea halalkaliphila
MPLRLPERVYKMISSTGAECHFLPVNVSSLIKGYDAKSKLGEFGSQNKQEVTSDSFIRVKERCYKLEINRLGIPLNRLK

SEQ ID NO: 1113 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 1114 - protein, 1389 aa, Oenococcus kitaharae; identical to SEQ ID NO: 236

SEQ ID NO: 1115 - protein, 1535 aa, Ornithobacterium rhinotracheale
MNTILGLDLGTNSIGWALIKVLNDKTRLPLEIIDLGVVVIPTDQRTLDKFSKGESISKTAERTKQKGVRKLYERKKLRRERLHRVLNILGFLPEHYSKKIDFKKHLGQFFGNSQPKISYVENDHGKHEFIFMDSYREMLKEFSKHNIKNVPYDWTIYYLRKKALSQKISKEELAWVILNFNKKRGYYQFRDDNADENKENKIEKYYALKVTNVKKEDAQNYTITLENGWIYKNKSKISLLDWVGSTKEFISTEKFDNKGNIIKKKNGEDDRTLKLVDSEKDWIAIKKSTEDRIENYGKTVGTYLYEHLLKDPNQKLNGELINIIDRKFYKNELKQILEKQKEFHPELLNEDLFQKSIIELYPKNSTRQKELKNKDLCYLLIDDVIYYQRDLKKKNSTINKCSFESREYYLNGEKQIQKINCIAKSKPLYQEFRTLQFIKNLKVYEIIDGLEKDITSKLLPDFETKEHFFEWLNDKEKIDQLQLLSYKCFDLHDNVKNDLIAKGIKRPTEKAIRTELLEKYRWNYSKDNDRNFLLNETRFKILKYLKKVDKKLTLTNEQIESLWLLLYSAKDERELKNGLQKFSEKNKLPKKFSDIFISFPPFKKEYGAYSEKALKKLLSLVRFGKYWSFNKIDNNIQNKIMNILNGEVDDSISDRVREKTILLQDKNDFQDLPLWLASYVAYNRFSEVSEIKYWDSPDKIEFLKQHSIGNPIVEKIINETLKLIKDIWVIHGKSCKNFFSEIHIELSREIKSSSKKRAQITNNNTKNQKLNNLIKSLLIEMASDTKYENVTPYSPSQQEILKIYDEGIYSKEENSEKIKEINKIRNNNKISKSDITKYKLWLEQGYISPYTGKIIPLTKLFTAKYQKEHIIPQTKFFDDSFNNKVICEAEVNKLKDNSLAMNFIKAKGGKAVKLSDGETVTILNQEEYKQLVRTSFKKNSIKLRNLLLEEIPDTFTKRQLNDTKYISKLVLSLLSNIVREKGELESTAKRIVSTNGQITSILRNDWGLNNIWNKLITPRFERLNNINKNKIYGNWENKKGKNVFQINYLNDNLSTLNTKRIDHRHHALDALIVACTTRNHINFLNNQYAKSRNQRHDLRAKLKRRETITTEGSKKQVFKDFIKPWESFTQDALKKLETTIVNFKVNKRIINKTINWYKKWEKQKDGTYKKIQKKQTKGDAWAIRKPLHIDTIYGIVCKKLPLKSALENYKNIIDENLKHKIKELKEVNKFDNNQIINFFKECNFIFEDNNIQKVEVYDFKDNRDKTILSSSRQLIDESFTPKKIGKVLDPTIRNILLKHLNSTKYNNKFDSDGNPIKPEKLAFSPEGLKDLNKNIKHLNNNKEHQPIKRVKLFETLGNKIKVGYTQQKNKKFAETATGTNLFLGIYSDNNKRDFKTIPLILAIQREKEGLNPCPDTDEKGNQLLFSLSPNELVFVPNNEERKNPNLVDFENLSKDQIDRIYKFVSCTGSEAYFVPSRTAKPIIENENGTNNKSQRIIEFNEKTSIKNEKNEPVLIKTICWKIEVNRLGKIIKVIK

SEQ ID NO: 1116 - protein, 103 aa, Parabacteroides merdae
MIVYRLFYRFLFKATKLVNFVIHKELKRQIARTGKIKFHSGGCGCQSGNYKMQNFEKGKSITTNADRTLKRSMRRNLYRCKLRRDVLIELLKKVGFIPEKQWK

SEQ ID NO: 1117 - protein, 82 aa, Parabacteroides merdae
MSIWKLQYPPLDLKIYNKFLVYSRVNPLTVDEMQNFEKGKSITTNADRTLKRSMRRNLQRYKLRRDVLIELLKKVGFMSEKQ

SEQ ID NO: 1118 - protein, 84 aa, Parabacteroides merdae
MSIWKLQYPPLDLKIYNKFLVYSRVNPLTVDEMQNFEKGKSITTNADRTLKRSMRRNLYRCKLRRDVLIELLKKVGFIPEKQWK

SEQ ID NO: 1119 - protein, 398 aa, Pasteurella bettyae
MLANENQNKGNLTPYEWLDGKNNSKRWQDFVARVQTCCFSHRKKQHILSHKLDEKSFIERNLNDTRYVARFLCNFIADNMLLTGKGKRKVFASNGQITALLRGRWGLQKVRDDNDRHHALDAVVIACSTVAMQQKITRFVKYEEGNVFSGERIDRETGEIIPLYFPTPWKFFKENVEIRIFSENPKLELENRLPDYPQYNHEFVQPLFVSRMPTRKMTGQGHMETIKSAKRLDEGISVLKVPLTQLKLADLENMVNRERELALYEALKERLELFGNDPAKAFIEPFYKKGGALVKAVRVKKVQKSGVLVRDGNGVADNALMVRVDVFTKGGKYFLVPIYTWQVAKGILPNKAVTANIDEIDWLEMDESYQFIFTMYPNDLVKVKLKKEEFFGYYGGLD

SEQ ID NO: 1120 - protein, 610 aa, Pasteurella bettyae
MNMLKPLNYILGLDLGIGSVGWAVVEIDEQGNPLRLIDVGVRTFERAEVAKTGESLALARRLARSSRRLVKRRAARIKKAKRLLKAENILLSVDEILPNDVWQLRVKGLDHKLERQEWAAVLLHLLKRRGYLSQRKNESKSENKELGALLSGVVTNHQILQTDEYRTPAEIAVHKFQAEDGHIRNQRGDYTHTFSRLDLLAEMELLFQRQTELGNLHTSSKLLENLTALLMWQKPALAGEAILKMLGKCTFEPTEYKAAKNSYSAERFVWLTKLNNLRILEQGAERALTDSERFVLLDQPYEKAKLTYAQVRTLLKLSDEAIFKGVRYQGEDKKTVESKTTLMEMKAYHQIRKALDGADLKDEWNTLKNDSALLDEIGTAFSLYKTDDDISHYLGGKLSEKVLNVLLENLNFDKFIQLSLKALQKILPLMLQGQRYDEAVSAVYGDHYGKKSAESCRLLPAIPANEIHNPVVLRTLTQARKVINAVVRLYGSPARIHIETGRKVGKSYQDRKKLEKQQEENREQRESAVKKFKEYFPNFVGEPKGKDILKLRLYELQQSKCLYSGKSFDPNRLLEKGYVEVDHALPFSRTWDDSFNNKVCLPMKTRIKAI

SEQ ID NO: 1121 - protein, 199 aa, Pasteurella multocida
MACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNA

SEQ ID NO: 1122 - protein, 63 aa, Pasteurella multocida
MQTTNLSYILGLDLGIASVGWAVVEINENEDPIGLIDVGVRIFERAEVPKTGESLALSRRLAR

SEQ ID NO: 1123 - protein, 1058 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKESAESATFMELKAWHAIRKALENQGLKDTWQDLAKKPDLLDEIGTAFSLYKTDEDIQQYLEGKLPDSVINALLVSLNFDKFIELSLKSLRKILPLMEQGKRYDQACHEIYGHHYGEKNQQISQLLPVIPTQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKVRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYVGLKARLAEFNQDPAKAFATPFYKQGGQQVKAIRVELVQKSGVLVRQGNGVADNAPGSIVRTDVFIKNNKFFLVPIYTWQVAKGILPNKAIVAHKNEDEWEEMDEGAKFKFSIFPNDLIELRTKTECFLGYYIGPDRHNGSISLREHDSEISKGNAGVYRVGVKLALSLEKYHIDELGKNRRICRPHQRRPVR

SEQ ID NO: 1124 - protein, 1056 aa, Pasteurella multocida
MQTTNLSYILGLDLGIASVGWAVVEINENEDPIGLIDVGVRIFERAEVPKTGESLALSRRLARSTRRLIRRRARRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVFLNFDKFIELALKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKIRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 1125 - protein, 134 aa, Pasteurella multocida
MVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKK

SEQ ID NO: 1126 - protein, 53 aa, Pasteurella multocida
YSKENAESATFMELKAWHAIRKALENQGLKDTWQDLAKKPDLLDEIGTAFSLL

SEQ ID NO: 1127 - protein, 1366 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEEDRKFDIREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQTRPEFAALIQQANEKQFEGNDPNNVWENIESILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGKYLYKCYPKLRPYFVYGKFKKFGDNEDIEVGDGRFNFLNRIERLKNVTDPETGEILWSNVAPNETIKQIKKVYNYKFMLVSRETTTRRAELFNQTVYPKNYRGKLIPIKEDRPTDLYGGYSGNTDAYLAIVALEDKKKGKYFKVVGIPTRAAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 1128 - protein, 1229 aa, Pediococcus acidilactici; identical to SEQ ID NO: 125

SEQ ID NO: 1129 - protein, 270 aa, Pediococcus lolii
LFNQTIYSAKASKTMIPIKNDRPTKLYGGYSGNEDAYMSIIRLSDKKKTYKVVGISMRDASKLKAYENNAHEEYLKKLKEVIEQQFLDSGKKTKADFEIVIPKVNYHQRMQDGTKQFRIGSSKYVHNTKQLVLSEKTLKAIRNNKQYNGDAEKDLINAFDEILTIVNDSFSIFDIRSFRKKLNESRDKFVSLPVEDTKEKSKVIKGKRETLKQILIALHANGTSQDIPQLGLKSFGKMVKTGGLTLSENTALIHQSPSGLFEHKIKLSDL

SEQ ID NO: 1130 - protein, 1016 aa, Pediococcus lolii
MNGIFDAHLAEVDPTFLARLKESNRSNLDPKKSFQGSLLFPERKDYQFYKEYPTIYHLRKALMEKDRKFDIREIYLAVHHIIKYRGNFLNGTPMRSFKVENIELDTLFDRLNQLYEEIIPDNELAFDLEQVADVKEVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYKDHRHHLELLKKVIEDHSDAKKAKALKETYTAYVGKTDDKTQNKDDFYKAVEKNLDDSPEAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYEKFVVLNELNNLKINGRHLSLKDKQDIYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWHSTENFMQIQTRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDRLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIERDKKVVAPETGEILWSNVAPNETIKQIKKVYDYKFMLTSHETYTKHG

SEQ ID NO: 1131 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 1132 - protein, 211 aa, Porphyromonas catoniae
MGKKVLGLDLGVGSIGWCLITLDKDEKPQSILGMGSRIVPLSADDATEFTQGKAITKNKMRTVARTIRKGMDRYQLRREALKKVLREHAMLPDEALIKLPLLELWELRARAATPGEQVSLTELGRVLLHINQKRGYKHAKADEAAEAETKKGKETGYVAQVKGRYQILKEKGLTIGQHFAGELRANQQTAPRGTYYTYRIKEQVYPRVRGV

SEQ ID NO: 1133 - protein, 1009 aa, Porphyromonas catoniae
MRIIREAYIEEYDRIMAVQRVFYPELLTDALIGRIRDRIIFYQRPLKSCKQLVSFCEFEKKEKVIRVKHTNKEGVQELVEKTITIGPKVAPKSSPIFQVCKVWESIHNIRLYHPDGTERKLEQEEKQKLFDYLQRNDKLSLTTLRKELKIKPKDKLWCDKLLEKGIAGNTTAAILRKAFKGYEHYERLFRFDLVRRDSHEADEDGVIRPIIDESYQNEPLYKLWHILYSIEDRAEMRSALIGQLGIKAEDLDNGLMDALYKIDFVKQGYGNKSAKFICKLLPHLQEGKMYSEAAEAAGMRHSDSMTAQERDERNLLEEIPLLQKNALRQPVVEKVLNQMINLVNALKREHGEIDEVRVELARELKMSREEREKATKNNSSREKENKAIAERITEYGLTPTKSRIQKYRLWQESAESCIYCGKRVDVVQFLRGEETEVEHIIPKSILFDDSLSNKACACRSCNQEKGNRFAMEYIQAKGWEQDYIERVDSLFHDKKISYSKRQHLLMLPKDLPEDFIERHLRLSQYISREAQGILRKGIRLVSASEGGVTAKLRQLWGYDNILRDLNLERYKSMGETEVVTVEHRDGQRTDERIKDWSKRKDHRHHAIDALVVACTRQSYIQRLNRVNAEADRQEMDAFIKEQQQEHKLSKKEKLSLLENWLKEQPHFTTGEVKEHAEGILISFRPGKRTVSRGRNIYKRSGKTDVQRNVLIPRGALSEETVYGVISVDGENKVVCKYPLQKFLDTKETNVDKIADQAAEKIVDKVLREKIRERIKRYGKKEAFAEPLYLDEAQTQVVRSVRCFISKDQAKLIPLRYNDESEAVGFVAPGNNHHLALYRDASGKMRASVVSFFAAVERARYGIPMIVLNPRETREKARIIPDLPESIFSKLPEEDWVLEETLQEGEMVLLGMENDAIEEAIKKKDYSKLSRYLYRVQSLSYNDYKFCFHLETESEKKEKKKGEDKKRGEKAKNTAVMPPKRYRIRCLATYQEDLNPRKVKIDLLGRISLA

SEQ ID NO: 1134 - protein, 1197 aa, Unknown
  Porphyromonas sp. oral taxon 279 str. F0450
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 1135 - protein, 1422 aa, Prevotella denticola
MTQKVLGLDLGTNSIGSSVRNLDLSDDLKGQLEFFSSDIFRSSVNKESNGREYSLAAQRSAHSRSRGLNEARRRKLWATLDLLIKYGFCPMSPESLMRWRTYDKQRGLFREYPIDDKNFNAWILLDFDGDGKPDYSSPYQLRRELVIRQFDFDQPIERYKLGRALYHIAQHRGFKSSKGETLSQQETNSKQSLTDDTADVAGEMKASEEKLSKGLSTYMKENNLLTVGAAFAQLEDEGVRVRNNNDYRAIRSQFQREIETIFKFQQGLSVENELYERLVSEKKNIGTIFYKRPLRSQRGNVGKCTLERTKPRCAIGHPLFEKFRAWTLINNIKVRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGERWKKLYHPSQIAIYRPVPANKDRSALRLGNPDIGAIKNPTVLRVLNTLRKRVNQLLDDGIISPDETRVVVETARELNDANRKWALDTYNRIRHDENEKIKKILAEFYPKRDNISTVDIDKARYVIDQREMDYFTEAKTYHKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQYAKDKEGKVLMKEGRPQINPTIKFVIRRELKYKKSSTDSGFASWDDLGKAIVDKELFALMKGQFPEGTSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 1136 - protein, 443 aa, Prevotella disiens
MELDYWKGKYNRFTMTEIPEGFSRRQGMGIGLISRYAGLYLKTIFHKKDNPQKSNVYIVKGSITAEFRRIWNIQDDYEKKCRDNHIHHCIDAIVVGCIGKREYDLMAQFYRDEEKYRWEKKKKPFFKKPWETFTQDMLSLKDEVLTVHFNPSNFTKKAHKKVFTPKGIFVAQGDCARVKLHKESYFGAIEQKGEIKYVMRKELSALKIEDIKNIVDAVVKEKVLAVVKKKGFKQAMAEPIYMNEDKRILIKKVRLFVSQTNPLIVKKHRDLSSKEYKQNYYVDNEGNLMIAMYEGVKKNGKIDREITVVNNLEAAKFFRQSQKNNAEKQLISHLSPKNGYPLKTVLTQKQLVLMYEDSPKEIKLRDTKNMVKRLYQVVEIEKDGRVKLKFHQEARSEGLNKNSAAFKIQDTPESLYRHTKSNLKVLVNGVDFKINILGEISLI

SEQ ID NO: 1137 - protein, 1375 aa, Prevotella histicola
MKKILGLDLGTTSIGWALVYESENTDEKSSIVRLGVRVNPLSVDEKGNFEKGKAITTNADRQQTHGARINLQRYKLRRENLKDCLQKQGWIGTEALCEEGKTSTFETYMLRAKAAEEEISLHELCRVLFMMNKKRGYKSNRKANNKEDGKLFDGMTVAKKLYEEHLTPAEYSFQLLSSGKKFKQEYYRSDLKEEFDRIWNEQQKYYPEILTDDFKQQLQGKSKGNTSKIFLGKYGIYSADLKGLDRKLQPLKWRVEALKQQVDKEVLAFVISDLNGQIASTSGLLGAISDRSKELYFNKQTVGQYLWTSLKETPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSIHPLYEEEKNLLYEELSVKEKLSKAEALKVLNKNSKQWDLNYKEIEGNRTQAVLYDCYNRIIVMTGHEEYNFKKLKASEIRSYVKTTFTGLGFNTDILEFDSSLTGHELEKQPMYQLWHLLYSYESDNSRTGNDALLRKLETAFGFPKEYAAVLSDVVFEDSYGNLSVKAMRKILPHLQAGLNYSQACEEAGYKHSRRSLTKNELDQKEYKEKLELLPKNSLHNPVVEKILNQMINVINAVIDEYGKPDEIRIELARELKIGAAERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRDTQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMVKVGAALDEVTIKKVSSSFIREALLDRLHEYNGDAKKAFTGRNSIDKNPIYIDEEHKKTVPALVKTIEWEMYHPTRKLISPDLKIDKVIDKGIREILKTRLAKFNGDAQKAFSNLDENPIYKDEAKKITLKRVSLEGVSSVIPLHTLKDREGKLVVGKDGKPVLGDYVQTSNNHHIAFYMDENGNLQDNVVSFFEAAERKSQGVPVIDKNYNHDKGWNFLFTMKQNEYFVFPNEVTGFNPSEVDLMDEANYSIISPNLYRVQKMSKASGRDYWFRHHLEAMLNDDPKLRNSMFKRITSLKALEGIVKVRINCIGKIVAVGEYD

SEQ ID NO: 1138 - protein, 1380 aa, Prevotella intermedia
MKRILGLDLGTTSIGWALVNEAENNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKFQPLKWRVEALQQQVDKEVLAFVISDLKGQIANTSGLLGAISDRSKELYFNKQTVGQYLWASLEENPHISIKNKPFYRQDYLDEFEKIWETQAAFHKQLTPELKQEIRDIIIFYQRPLKSKKSLISVCELEQRKVKATIDGKEKEITIGPKVAPKSSPVFQEFRIWQNLNNVLLIDNDTNEKRPLDEVERNLLYKELSIKAKLSKTEALKILNKKGKQWDLNYRELEGNRTQAILFDCYNRIITLTGHEECDFKKIKASEIRHYVSTIFKNLGFSTEILDFDPSLKKHELEKQPMYQLWHLLYSYESDNSRTGNESLLRKLETTFGFPEEYATVLCDVVFEEDYGNLSVKAMREILPYLQAGNDYSQACAYAGYNHSRHSLTKEELDQKVYKERLELLPKNSLRNPVVEKILNQMINVINAIIDEYGKPDEIRIEMARELKSSAADRKKTTHAISQGNAENQRIREILEKEFSLSYISRNDIIKYKLYEELEPNYYKTLYSDTYITKDKLFSKDFDIEHIIPKARLFDDSFSNKTLEARNINLEKSNKTAFDFIKEKYGEDGAEAYKKKLDMLLENDAISRPKYNNLLRAEADIPSDFINRDLRNTQYIAKKACEILGELVKTVTPTTGKITNRLREDWQLVDVMKELNFEKYEKLGLTEIVEDRDGRKIKRIKDWTKRNDHRHHAMDALAIAFTKPSFIQYLNNLNARSNKGDSIYAIENKELHYEEGKLRFNAPIPVNEFRAEAKRHLSAILVSIKAKNKVMTQNVNKIKTKHGIIKKIQLTPRGPLHNETIYGTKMRPIIKMVKVGAALDEATINKVSSPAIREALLKRLNEYSGNAKKAFTGKNTLEKNPIYLNAGRTKTVPSLVKTVEWESFHPTRKLIDKDLNVDKVVDKGIREILKARLEEFNGDAKKAFSNLEENPIYLDEAKKIALKRVSIEGVLSAIPLHTLKNQAGKPITGKDGKPVLGNYVQTSNNHHIAFYYDEDGNLQDNAVSFFEAAERKSQGIPVIDKDYNRDKGWRFLFTMKQNEYFVFPNEATGFIPSEVDLTDEANYGIISPNLYRVQKVSRIDKGTSASRDYWFRHHLETILNDDAKLKNLAFKRIRGLLELKDIIKVRINSTGKIVAVGEYD

SEQ ID NO: 1139 - protein, 129 aa, Prevotella multiformis
MQKGGTGCKINRQTVGNVEVNVLNLRLYDRTDDREVTAGYLPTKEDYVRLFVYLNDRKEINQDTLLKDYFRLKKVKCGNEKEFAIRWNYIEDKEKKYPCNETRHELLAALDRAGMEHGWLDDSGTSARW

SEQ ID NO: 1140 - protein, 535 aa, Prevotella multiformis
MVKGLLSNIVRTAEEREETSKFVISCTGRITDRLKQDWGLNDVWNSLVYTRFKRLNELTETEAFGHWQDKDRRVFQTSVPLELQRGFSKKRIDHRHHAMDALVIACASRNIIGYLNNESAESPEKREDLRRKLCDKNHIIRKPWESFTQDARAALEDIVVSFKNYVRIINKATNYYERYDADGRKTKAEQKGGEMWAVRKPMHEATYYGKVNLRRKERVSLKAALEDIPSICNRDLRDYINGLVEKHFNKEQVLAQFRSVGNRWNKQHIDKVDVWRFSDGKEEMVATRKPLDTSFDAKRIEAVTDTGIQRILSNYLEAKGGDPKIAFTPEGIADMNQHITAYNNGKQHKPILKVRVSTKLGKKYPVGQTGCKAGQFVVAEAGTNLYFAVYEDGEGNRSYDTIPLNEAVECLKQGLPPVPETREKGDRLKFYLSPNDLVYVPAGDEENEIDRERIYKFVDSSGTTANFIPHRTAGLIYNVDKKLAEALCNGSIIQNEYGVGSQQSKNQKALTGEMVKAVCWKLEVDRLGNILRIIK

SEQ ID NO: 1141 - protein, 1380 aa, Prevotella nigrescens
MKRILGLDLGTTSIGWALVNEAESNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKLQPLKWRVEALKQQVDKEVLAFVISDLKGQIANTSGLLGAISDRSKELYFNKQTVGQYLWASLEENPHISIKNKPFYRQDYLDEFEKIWETQATFHKQLTPELKQEIRDIIIFYQRPLKSKKSLISVCELEQRKVKATIDGKEKEITIGPKVAPKSSPVFQEFRIWQNLNNVLLIDNDTNEKRPLDEDERYLLYKELSIKAKLSKTEALKILNKKGKQWDLNYKELEGNRTQAILFDCYNRIITLTGHEECDFKKIKASEIRHYVSTIFKNLGFSTEILDFDPSLEKHELEKQPMYQLWHLLYSYESDNSRTGNESLLRKLETTFGFPEEYATVLCDVVFEEDYGNLSVKAMRKILPYLQAGNDYSQACAYAGYNHSRHSLTKEELDQKVYKERLELLPKNSLRNPVVEKILNQMINVINAIIDEYGKPDEIRIEMARELKSSAADRKKTTHAINQGNDENQCIREILEKEFALSYISRNDIIKYKLYEELKPNGFKTLYSDTYIPKDKLFSKDFDIEHIIPKARLFDDSYSNKTLEARDINLAKSNKTAFDFVKEKYGEQGAEAYKKKLDMLLGNNVISKPKYNKLLMTEADIPSDFINRDLRNTQYIARKACEILGELVRTVTPTTGKITNRLREDWQLVDVMKELNFEKYEKLGLTEIVEDRDGRKIKRIKDWTKRNDHRHHAMDALAIAFTKPSYIQYLNNLNARSNKGDSIYAIENKELHYEEGKLRFNAPIPVNVFRAEAKRHLSAILVSIKAKNKVMTQNVNKIKTKHGIIKKIQLTPRGPLHNETIYGTKMRPIIKKVKVGAALDEATINKVSSPAIREVLLKRLNEYSGNAKKAFTGKNTLDKNPIYLNAERTKTVPASVKTVEWENYHPIRKPITPDLKVDKVIDKGIGEILKARLEEFNGDAKKAFSNLEENPIYLDQTKKIALKRVSIEGVLSTIPLHTLKNQAGKPIMGKDGKPVLGNYVQTSNNHHIAFYYDEDGNLQDNAVSFFEAAERKSQGISVIDKDYNRDKGWRFLFTMKQNEYFVFPNEATGFIPSEVDLTDEANYGIISPNLYRVQKMSRIEKGTSVSRDYWFRHHLETILNDDSRLKNSAFKRINSLKPLEGIIKVRINSIGKIVAVGEYD

SEQ ID NO: 1142 - protein, 1506 aa, Prevotella nigrescens
MKTILGLDLGPNSIGWAKVEVDDEGNYLRNIKLGSRIIPMTQDMLGDFDKGVKVSQTAIRTDFRGNRRLIERHLLRRERLHRVLHALKFLPKHYEDAIGWDRNEPATYGKFVNNSEPKLAWERQEDGSMRFLFMESFNEMVADFAQNQPSLVSDGKKIPLDWTIYYLRKKALTRPIKKEELAWILLNFNQKRGYYQLRGEEEEDNLTKRKEYYKLKVVGVEADGAPKGGKTWYNIHLENGWTARCQSKIPLDDWVGKVKEYIVTTEYEDDGKTPKCDKEGKVKRSFKSPEKDDWQLIKTRTEKFIDDSNKTVGAFIYDYLLEKPFDKIRGKYIRTIERKYYKNELREILREQTKYHEGLHSLEALKICAEELYKNNQQHQEYLLKKDMTFLLLNDLIFYQRPLKSKKSLIADCPYEVYKYDDKLTGKKGQKKIKCIAKSNPYYQEFRLWQFIANLRLFSVTDGKEVTAEYLKTEEDYVRLFSFLNDRKDIKQETFLRSFLKLKKESIGSEKIYPIRWNYIEDANKSYPCNATRHELLLAFDRADIPRELLDVEEREYRLWHLLYSIEAKEETESALRKLKANKAFGDLNIDDAFVNSFLKIKPFEKEYGAYSEKAIKKLLAVMRRGSLWKEADICEATKQNIAKILQNDIDEKLKKKIEAAVSSFNKLSDFQGLPTWLACYVVYGRHSEAAQIQCWQSPEDLKTYINKFKQHSLRNPIVEQCLLETLRTVYDIWKDAGQIDEIHIELGRNMKSTAEQRARKTKDILRNENTNLRIKNLLVELKNDDKIENVRPYSPSQQEILRIYEEGALQELSKEDEMFEDISKISKMAQPSPTELSRYKLWLEQKYRSPYTGRVIPLSKLFTTAYQIEHIIPQSRYFDDSFNNKVICESEVNSLKDNMLGYEFIKECGGRIVHCTLLGDVKIFTKEEYKDFVTKHYIDNTYKRDKLLLEDIPQEFSARQLNDSRYISKMVQTVLSNIVRAENEQEATSKFVVSCNGAITNRLKKDWGLNDVWSSIVCPRFKRLNEITKTNAFGHWEDKAGKHVFQTTVPLELQRGFSKKRIDHRHHAMDALVIACASRNIVNYLNNESANSPEKREDLRKKLCDEKRKIRKPWKTFTQDAREALSDVVVSFKNYVRVINKATNYYEHYSSSGNKVMISQKGNDMWAIRKPLHKESVFGRVNLCRKVIVSLKKALENIPAICDKTLRDYINALVEKHFNTRQLLAHFKSINYRLNRQCVEKVEVWQFSDEKIEMVARRKSLDTSFDDKQISSITDTGIQKILLNYLQTKDGNAEIAFTPEGIEEMNKNISLYNDGKAHQPILKVRVATPKGMKYPVGQTGNKATKFVVAEKGTNLYFAIYENELGVRSYDTIPLNIVVERLKEGLSPVPQANEADIPLKFYLSPNDLVYVPTKENEDELCRDRIYKFVDSSGTTANFVPHTSANTIYNVDKEYAEKCCNGAVFLNEYGLGSPQSKNQRALTGEMIKEICWKLKVDRLGNIIKVIK

SEQ ID NO: 1143 - protein, 774 aa, Prevotella oulorum
MEQCILETLRTVYDIWKEAGQIDEIHVELGREMKQTAEQRAHLTEKVLRNENTNLRIKSLLMELKNDADMKDVRPYSPMQQEILRIYEEGALQTLSKDDAAFTEIMKISKMAQPSASELQRYRLWLEQKYRSPYTGKPISLSKLFTSAYQIEHIIPKKRYFDDSFSNKVICEAEVNGKKDSMLAYEFIKDCGGDVIHCTTLGDVTILSEAEYKALVTELYANNKSKKDKLLMEDIPQDFINRQLNDSRYISRVVMTLLSNIVRIEGEEEATSKFVIPCSGGITDKLKKDWGLNDVWNNIVYPRFERLNALTNTSDFGQWENKEGKRVFQTSVPLELQRGYQKKRIDHRHHAMDALVIACASRKIINYLNNQEANDPTKQENARKQLCIKSRIIRKPWETFTQDAYKALDNIVVSFKNYVRVINKATNYYERYNADGKKAVDEQKGEAMWAIRKPMHKDTVFGHVNLRRKAVVKLKDALENIPAICDKTLRHYIQDLQKKHFNTKQLLAHFKSINYRLNKQAVDKVEVWQYSDDKEQLAATRKPLGPSFDAKCIAAITDTGIQKILLNYLQAKGGDPAIAFTPEGIAEMNQNIAVYNGGKQHQPILKVRIAKPMGKKFPIGQTGNKAFQYVIAEEGTNLYFAIYEDEEGNRTYDTIALREVVERLKQGLTPVPEKNEKGVALKFHLSPNDLVYVPTADELLSKVCSLDKNRIYKMVSATKSECLFIPHSVAKTIYDKVEFEALNKMGRALTGEMIKSVCWKIEVDRLGHIVNIIK

SEQ ID NO: 1144 - protein, 691 aa, Prevotella oulorum
MKTILGLDLGTNSIGWAKVIVDDNENYLRDIQLGSRIIPMSQDVLGKFDKGVTESQTAIRTSFRGVRRLRERTLQRRERLHRVLHTLHYLPPHYDSAIGWDRKTPTTYGKFLNHGEPKLAWERREDGTMQFLFMDAFHEMIADFAKYQPALVADGKKVPLDWTIYYLRKKALTQPIKKEELAWILLNFNQKRGYYQLRGEEDEENAAKHEEYHELKVVGVEVDEAGKGDNTWYNVKLENGWTYHRQSKIPLDDWVGKVRAFIVTTEYEKDGTTPKKDKEGNVKRSFRSPDEKDWGLRKKQTEHSLEASGTPVGAFIYDHLLKEPSDKIRGKFIHTIERKYYKQELAAILREQSKHHEKLCSKDMLKACIEELYPNNPLHRESLLKKDMPYLLIEDLIFYQRPLKSKKSLIAECPYEAYSYVDKETGEMKRQGIKCIAKSNPYYQEFRLWQLIANLRLRNRSDERDVTAEYLPHQEDYVRLFTYLNDRKEINQETLLKDFFKLKKVTIGGEKVFPIRWDYIEDKEKKYPCNATRHELLLALDRAGIEHDWLNDRDLAYRLWHLLYSVDSKDETERALRKLKDDDAFVESFLKIKPFEKEYGAYSEKAIKKLLPVMRRGSLWNEADLCPSTKERIANILQGTIDEKLKKKIGAFISSCQQVSDFQGLPEWLACYVVYGRHSEATDIQRWETPE

SEQ ID NO: 1145 - protein, 242 aa, Prevotella saccharolytica
MKLVLGLDLGVGSVGWALIFITDSGEPIKILALGERIVSMDSNNSNEFSAGATCTLNQKKTKAKSVRKGYSRYVQRRDALTAELRHIGMMPDETLIKLPVLDLWQLRANAATEGKKLSLAEIGRVLYHINQRRGYKHGKSDVSSDNKQKGYVKAVNERYCMIQERQQTIGQYFALKLKETAVTTEKGTFYTFRIKDQVFPREAYEEEFVVAYSTKVLKFKQITTLLNVVICLMMLLLIVQRY

SEQ ID NO: 1146 - protein, 1174 aa, Unknown
  Prevotella sp. oral taxon 317 str. F0108
MEFHPELCDAELLKACAEELYRNNEAHRAQLLAKDFKHLLVEDVLFYQRPLKSKKSLIANCPYETRQYINKETGEIKDVNVKCIAKSNPYFQEFRLWQWISNLRLLRQADGQDVTAAYIKGNEDKERLFDLLNNQGEIKQEHILRDFLKLKKPKGGEFPLRWNYVDDKIYPANETRHAINKAIKGMAVDKEEKETLGQLLDQPAVAYMLWNLLYSITDRNELARALRRFALTHGVSSVDAFVESFLKVKPFKKEYGAYSEKATKKLLQVMRLGKYWCGDELPEPAKRTKGNKQAVYDEMAHRGICKQTLQNISNIIEENIDERLMGALLNPERPLTELSHFQGLSVSDACYVVYGRHSEVAEIVKWKDADELNTFINNFKQHSMRNPIVEQCVLETLRTVRDVWEQEGQIDEIHVELGRNMKRTAEQRARDTQAIQRNENTNMRISLLLTELKNDPSISDVRPYSPSQRELLKIYEEGALENLTNQDEDIAKISRLAQPSASELRRYKLWLDQKYVSPYTGRPIPLAKLFTPAYEIEHIIPQSRYFDNSFSNKVICEAEVNKLKDNLLGMEFIKKFGGKTKGILDEEAYKLHVTTNYAHNPAKRSKLLMEDLPTDFNSRQLNDTRYISKTVMALLSNVVREEGERETRSKHVVVCTGGVTDTLKKDWGLHDVWHNLVYPRFIRLNNLTGSQNFGYWRYLNEENSKKGEDSKKVFQITLPPECQRGFVKKRIDHRHHAMDALVIACASANIVNYLNNQSAANPHIHENLQRLLCDRKREIRKPWPTFTQDAQAALKDLVVSFKNTVRVVNKASNTYLRYDKDGKKKRFKQEGEGLKAIRKPMHKETYYGEVNLIRKEMVPLKRALDDVNAIVDKELRASIKGLLRDGFNPQQVLANFKAKDFKFDKRDIKKVEVYVSSEKSTPMVATRKSLDTSFNAKRIADITDTGIQKILLNYLKANDNSPEQAFTPEGIAYLNEHIAEYNDGKPHQPILKVRVSEVKGAKFAVGQTGSKKDKFVEAQSGTNLYFAIYEDKEGKRHFETIALKVAAERLKDKQMPVPEINDAGLPLKFYLSPNDLVYVPTDEDRATAHPSIDKMRIYKMVSATDRQCFFLPFTVASVISNKVEFEALNKMERVLDASEYSSAYDSSHVNKVMVKNVCWKLEVDRLGNITKIVR

SEQ ID NO: 1147 - protein, 992 aa, Unknown
  Prevotella sp. oral taxon 472 str. F0295
MITRILGLDTGTNSLAWAVVDRDANGNYTLVKRGDVIFTEGVKIEKGIESSKAAERTAHKALRVHYSRRRLHKIDTLKVLVELNLCPCLSDEQLSQWKAKKTYPLTDDFMLWQRSGSAEENNPYYCRHRCLTQKLDLTDQSQRFLLGRAFYHLAQRRGFLSNRLDTSADSDESGKVKSGIAQLSVEMEKAGCEFLGEYFYQLYKQHGNTIKLRSRYTDREEHYKKEFLAICEKQELDPKWVEALQRAIYFQRPLKSQRKGVGKCTFEPKKPRCAESHPDYEAFRMLCFLNNVKIQTPNDTSLRPLNEDEREKIWPIFFRKSKPNFDFEDIAKALAGKNNYAWYKDAGEKPFKFNYRMQQGVSGCPVTAQLIDIFGSDWQTAIAETYTAVEKKNGTKTIDEMADDVWNVLYSFSSKDKLKAFATEKLQLDEASATKFANAKLPHGFASLSLKAIRNILPFLRQGFIYAHAVHLAKIPDIVTKAVWNDADKREMILSGLMEIIENYNPKDRGVEGTIDFCIKSHLQDVIDLRPGAADALYHPSMIETYPDAKLNKMGVFQLGSPRTNAIRNPMAMRSLHILRSVVNQLLRDGIIDRDTEVHVEYARELNDANKRKAIADYQREQEKKRKQYRDDIIALYKSECHKEIEPTDTDILKFQLWEEQNHLCLYTGTQIGICDFLGDNPKFDIEHTVPRSVGGDSTQMNLTLCDATFNRQVKGAQLPSQLSNHADILVRIDHWKSKCEDLRKQLDKIRTYGGMEKNMKDRLIQKRHRLKMDLDYWQGKYSRFTMTEVPEGFSRRQGAGIGLVSKYAGLFLKSLFHNEQNPNKSNVYVVKGVTTAEFRRMWGLQGEYEKKSRLNHCHHCIDAITIACIGKAEYDKMAQYYHDEELFQWRGTTTKPHFNKPWPTFTEDVLAIEQSLLVKHLTKDNMPKQAKKRVRTATGKYLAQGDTARGSLHKDTYYGAIEQNGEIRYVLRKPLNKFENEAELEKIVDQA

SEQ ID NO: 1148 - protein, 1375 aa, Unknown
  Prevotella sp. oral taxon 306 str. F0472
MKKILGLDLGTTSIGWALVNESENKDEQSSIVRLGVRVIPLTVDEKGNFEKGKAITTNADRQQVHAARINLQRYKLRRENLRDCLQKQGWIGSEPMCEDGKSSTFETYKLRAKAAVEEVSLHEFARVLFMLNKKRGYKSNRKANDKEEGKLFDGMTIAKKLYEEHLTPAEYSLQLLNTGRKFTPEYYRSDLIEEFEKIWNEQQKYYPEILTDEFKQQLEGKAKSNTSKLFLGKYGIYSADTKGLDRRLQPLKWRVEAMKQQVDKDVLAFVISDLKGQIANTSGLLGAISDRSKELYFSKQTIGQYLWASLQENPHISIKNQPFYRQDYLDEFEKIWETQATYHKELTSELKQEIRDIIIFYQRPLKSKKNLIAVCELEQRKVKVTVDGKEKEITIGPKIAPKSSPMFQEFRIWQNLNNILLLDHETNSKRPLYEEERNLLYEELSVKEKLSKTEALKVLGKKSKQWDLNYKELEGNRTQAVLYDCYNRIIVMSGHEECNFKKLKASDIRHYVKMIFKNLAFNTDILCFDSSLKGHELERQPMCQLWHLLYSYEGDNSRTGNDALLRKLETSFGFPKEYAAVLADVIFEDSYGNLSVKAMRNILPHLQAGKDYSQACEEAGYKHSRRSLTKEELNQKVYKEKLELLPKNSLHNPVVEKILNQMVNVINAVIEEYGKPDEIRIELARDLKIGAAERENMTRSINQGNAENKRIREILEKEFALSYLSRNDIIKYKLYEELKSNGFKTLYSDTYISKDKLFSKDFDIEHIIPKARLFDDSLSNKTIEARDVNIAKSNKTAFDFILERYGEQGVKTYKTKLLRLLEDGAISNKKYNNLLKTEADIPSGFIDRDLRNTQYIAKKAYEILSELVKIVTPTTGSVTNRLREDWQLVDVMKELNFEKYQKLGLADVIEDRDGRKVKRIKDWTKRNDHRHHAMDALTIAFTKPSYIQYLNNLNARSDKSSSIYGIEVKELHREEGKFRFNAPLPINEFRAEAKRHLKSVLVSIKAKKKVMTQNVNKIKTKHGIIKKVQLTPRGELHNATYYGTKKRPLVRMVKVGAALDEATIKRVCSPAIRAALLKRLNAYNGDAKEAFTGRNSIDKNPIYLDIEQTKLVPVLVKTIEWGMYHPIRKRITPDLKIDKVIDKGIREKLKARLAEFNGDAQKAFSNLDENPIYMDEAKRITLKRVSIEGVLSAIPLHTLKDKAGKPVIGSDGKPVFGDYVQTSNNHHIAFYIDDKGNLQDNPVSFFEAAERKSQGVPVIDRRYNCDKGWHFVFTMKQNEYFVFPNEATGFIPSEVDLLDEANYCIISPNLYRVQKLSKASGRDYWFRHHLETMLNDDLRLKNSTFKRIQSLKGLEDIVKVRINSIGKIVAVGKYD

SEQ ID NO: 1149 - protein, 1483 aa, Unknown
  Prevotella sp. MSX73
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGTTLKTDKEGNVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQRWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIVEMNQNISKYNDGKPHQPILKVRITEPMGAKYRVGQTENKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGSECHFIPYYVANVIYNKVEFEAKNKIGRALTGEMIKAVCWKLEIDRLGNILKVIK

SEQ ID NO: 1150 - protein, 593 aa, Unknown
  Prevotella sp. oral taxon 317 str. F0108
MNTRILGLDTGTNSLAWAVVDRDAKGNYTLVRRGDVIFTEGVNVDGQPVPSKAAVKSKYKSLRVQYARRRLRKIDTLKVLVSLDLCPYLSDQQLSQWKAKKTYPLTDDFMLWQRSGSAEENNPYYCRYRCLTQKLDLTDQSQRFLLGRAFYHLAQRRGFLSNRLDTTSDSAESGKVKSGIAQLSVEMEKAGCTFLGEYFYQLYKQHGNTVRLRSRYTDREEHYIKEFLAICEKQELDAQWVEKLQRALYFQRPLKSQRKGVGKCTFEPKKPRCAESHPDYEAFRMLCILNNIKIKTPKDVSLRPLNAEEREKVWPLFFRKSKPNFDFEDIAKALAGKNNYAWYKDAGEKPFRFNYRMHQGVSGCPVTAQLIDIFGSDWKAGIAETYTAVGKKNGTKTIDEMADDVWNVLYSFSSKDKLKAFATDKLQLDEARATKFANAKLPHGFAALSLKAIRNILPFLRQGFIYAHAVLLAKIPDIVTAAVWDDADKREQILSGLLEVIENYNPDDRGIEGTIDFCIKSHLQDVVDLRPGAADALYHPSMIEAYPDAKLNKMGVFQLGSPRTNAIRNPMAMRSLHILRSVVNLLLRDGMLS

SEQ ID NO: 1151 - protein, 1424 aa, Unknown
  Prevotella sp. C561
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 1152 - protein, 241 aa, Unknown
  Prevotella sp. oral taxon 472 str. F0295
QAVKEKIKEAIAGKNFKTAIAEPIFMNKEKGIRINKVRYYVKAQERLKIRQQRDLSSKEYKQFFCVENESNYLLAIYEGELKGKKERDFCVVNNLDSAACLKRSNKGKAAPLVPERSEERNLPLLAVLKRGTQVLFYENSPEEILFDNPQDLVRRLYKVTGINTKKDVKNGKTYLYGNIELRFHQNAQKKDDVKMQSGVYKNNEVLRQGIVLSHKQFKALVEGVDFEFNVLGEIKKKERHA

SEQ ID NO: 1153 - protein, 1216 aa, Prevotella stercorea
MTKILGIDTGTNSLGWAIVDKTADNYNLLDKGVNIFQEGVKIEKGIESSKAAERTEHRATRVRYYRIKLRKIRLLRILSDNHLCPPLSQEELSTWRLKKVYPKNELFMQWQRTDDDTEKTPYAYRHKCIHEKLDLSDVTDRYILGRAFYHIIQRRGFLSNRKEQGGEDSGKVKEGISTLTHEMNEAGYEYLGDYFYALYNKGEKIRKHYTARNEHFLSEFKAICEKQDLEKELGSEVVRNIEKAIFDQRPLKSQKGQVGKCVFEKNKTKCPSSHPMYEEFRMLTFINNIKIKTPNDDVLRPLNTGEREKIMPLFFRKSKKQFDFEDITKKLAPKKMYGFYKKEEDAEMPFLFNYPMDTSVSGCPVTAALKDVFGDDWITAICETYTLGEGKSRFDIVNDIWHALYFYSDKDKLAEFAINRLQLSEDEAKIFSEISLPADYASLSLKAICKILPYLRRGLIYSHAVFLGNLCEVMPKYEWSIKEMRETIIDNIIMEMDKCDTKDKRTFEVCIKDYLKGQYNVSDNSLKKLYHPSMIETYPRVQYTNEHGVYQLGSPRIDSVRNPMAMRSMFRLRKLVNRLLVEGKIDQNTEVHIEFARELNDANKRNAIALFVKENQSANDEARKQIITLFKKETGTDIEPTDKDILKYVLWEEQNHICLYTGKQIRISDFIGANPKFDIEHTIPRSVGGDSTKMNLTLCDSRFNREVKKTKLPVELPNHDEIMERIKEWKKNYELLDIQIRKNKKLSKGATTKEQKDTIIRKRHLLELRRDYWRGKYERFTMESVPEGFSRRQGTDISVISKYARLYLKSLFNRVYTVKGIATSDFRKIWGIQDIYSKKERINHVHHCIDAIVIACIGLDEYNKLGAYYHDEENNKWYGMSKASFKKPWATFVEDIKKIQDEILVYHYTPDNMPKQGRRRIKIDGKKILCKGDAARGSLHNDTYYGAIENDGAVKYVKRIDLASLEEKDVKNIVDDTVRSIIEAAIKEKGFKDAMASTIWMNEEKRVPIKKVRCFTPSITKPLNIRKQRDVSIKEYKQQYHVANDSNYLLALYIGTDNKGKEKREFEIVNILQAAQYYRTSNDKEVVDRHIVPIKSEHDYPFAYTLKIGTMVLLYEKSPNEVWDATIKERNRRLYKVTGLSTMRMKGRNGEYAYATVKLIHNEEARPSKDIKAKNGEYEQGEEFRPAIIMLHTQLNALVQGYDFEINELGEIRRLR

SEQ ID NO: 1154 - protein, 1487 aa, Prevotella timonensis; identical to SEQ ID NO: 130

SEQ ID NO: 1155 - protein, 770 aa, Pseudoramibacter alactolyticus
MAKGYFASDEEIDFSGVDDGFKNTLSSHQKFKEIFDVEVLNDWQKSMSEKIIFWATVYGDSKKFLKERLEDAYGNELDQKQIKRILGLRFKDWGRLSEAFLNLEGKNSKTNQSQTIIEALWNGDGTNNFNLMELLSSQFTYRDTLKKRALKGEKTLTNITYEDLSDLYLSPSVRRMVWQTILIVKELRQVLGAGPAKIFIEMARDVTLKAGTRTTSRRQQLLDLYKNVQTESRNWVEEIETQEESRFRSKKIFLYYTQMGQCMYTGEPIVFKDLFNRNLYDIDHIYPRHFVKDDSLINNLVLVKKQANSHKSDTFPIENSIQQARRDFWKWLSEKGLISREKFNRLTRRTSFSDEELAGFISRQIVETRQGTKAVAQIFENALPDSEVVYVKAGNVSDFRHHFNLLKCREINDLHHAQDAYLNVVVGNVYHTKFTKNPINFIKGYRKDRKAYAYHMDQIFDHPVKRNDIIAWQTDKNQSIATVKKVMAKGTPLVTRMSYEEHGELSNQNICSAKAAQKAEGKGYLPIKNSERLSNTQRYGGYNKYAGSYFFLVEHTLKKNRVRTIETMPLFLRDTIKTSKDLLKYCCESLKLEAPSIRVMKIKMGSLLSVNGAFVYLTGRSGKKLITPNGFQLILPQKWQDYIRLLIKTKDSPDDVEGISGGKNIEFYDILVEKHTKTCLKNRPNPIGEKLREWRNDFIALDNQKQSDILLEILKLTTFDNSGADLRAIGGKNQSGVSTIGKKISSQKSVVLVHRSVTGIFEKQVDLLSI

SEQ ID NO: 1156 - protein, 103 aa, Rhizobium etli
MSGEQLTREIGRSGVKASAVGLGTWAIGGWMWGGTDEAQSIAAIQASLDAGVTLIDTAPAYGLGRSEEIVGKALAGRRDKAVIATKCGLVWHTQKGNHFFDQD

SEQ ID NO: 1157 - protein, 1059 aa, Unknown
  Rhodovulum sp. PH10
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 1158 - protein, 1405 aa, Riemerella anatipestifer
MKTILGLDLGTNSIGWALVKEAENSNEKSEIIKLGVRVNPLTVDEKTNFEAGRPLSTNADRTAKRSARRNLQRYKLRRKNLIDLLIKNQLIDKDTPLTEIGKNTTHQTLELRAKAARERIELEDLARVFLAINKKRGYRSSRKVNNEEEGQAVDGMAVAKKLYDENLTPGQYAYELLSKGKKYVPDFYRSDLQAEFNAIWEYQKQFYADILDDELYNALKGQGQQNSRKRFLAIKGVYTAENKGKRDDVKLRHYKWRSEAISKKINIEEVAYVLVEINNDLNKSSGYLGAISDRSKELYFNKETVGENLWKQIQKNPHTSLKNQVFYRQDYLDEFEQIWETQAQFHPQLTLALKEQIRDVIIFYQRKLKSQKGLLSFCQFESWEIERKDENGNVILNKTTQLPKRQTVGRRVAPKSSPLFQEFKIWQNINNLEVTKISEGASKNKKETETLSDDERKLLFEELNLRGNLSQKEVLQILGLKDKEYKTNFSEGLEGNRTNAALFNIYQQIAENEGYGFDWSKKSAQEIKEELKAVFPQIGIQADILDFNANLDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRELLDKLELLPKNSLRNPVVEKILNQMVNVVNQVIETYGKPDEVRIELARELKKSAEKRAEMTKSINEATRRNEDIKKLITKDFGIPNPTKSDVVRYRLWEELAPLAYKDVFTGKQIKKEDLFSSKIDIEHIIPKALLFDDSFSNKTLVFRETNLKKADRTAYDFIESDYNATLDDYIQRVETLYNNTKGTISKGKRNKLLMAQKNLPDGFIERDLRNSQYIAKKAKAMLYQVFKDVNVTSGSITDRLREDWDLINVMKELNFPKYKALGLTEIEERYDIGQEKTKRVEVITDWTKRNDHRHHAMNALTVAFTTSSHIQYLNYLNARKNESHKEHKNIKGIENKITHKQKDKRKFIPPMPNFREEAKKHIETILVSIKNKNKVYTKNINKTKKKSGHNTKEQLTPRGQLHKETVYGKSKRPMSKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKKKGICIKRVTITGVSNAEALHHQKDHLGREILDDNGNPIPADFVSTGNNHHLAVYLDSEGKLQDNIVSFYEAVVRTSQGLPVVDKGLNKDLGWKFLFSLKQNEMFVFPNDDFDINDFDLLDDKKAELISKHLYRVQKISKVSAGNSFVRDIVFRHHLETTVKEVKELKDISYIQLKSLEGLRNIKKVRINHIGKIVQVGEY

SEQ ID NO: 1159 - protein, 1145 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKCHYLKMVNL

SEQ ID NO: 1160 - protein, 1400 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKEKGICIKRVTITGVSNAEALHHQKDHLGREILDDNGNPIPADFVSTGNNHHVAIYEDEKGKLQEKVVSLYEAVARANQGLPVVDKGLNEDLGWKFLFTMKQNEMFVFPNDDFDVNDIDLLDENNAKIISQHLFRVQKLATKNYMFRHHLETNVQEVKELNDIAYKSIRSTEPLKNIKKVRINHIGKIVQVGEY

SEQ ID NO: 1161 - protein, 1128 aa, Roseburia intestinalis
MDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRIGCSWSEKGYILTPRNKAENYQHTMLRAMLVEEVKEIFSSQRRLGNKKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTANKPYSEWRTMEDKDFLFSLYSRDLVHIKSKKGIPIKNVDGSLGESKEVYAYYIGADISGAKIEGKAHDSRYTFRGIGVQKLELIEKCQVDILGHISTVKNEKRMGFS

SEQ ID NO: 1162 - protein, 1471 aa, Scardovia wiggsiae
MGYKAPRNDKGEIDYGVGLDLGNGSVGWVAMDKDYHLIRARGHELIGARLFDPANSAENRRESRTTRRRLSRRRWRLRMLDSLFASELAKIDPNFLARRKYSWVHPKDEQNHENWYGSIIFGSKEQDKQFYKDYPTIYHLRKKLTEDTERHDIREIYVAIHHIVKYRGHFLREGEINSENLFDPEGFVELIKDVIKLNNSYDESTPIFEASPADVSEALLNEHTSRSGRIEDTLDKLDFSVSRVDKHELKGMRDAAKAVIGAIVGNTADFSKIFNLDNLDKDSKDNLKLKFADSNFDEKYGGVVGSGLLDETQIELVDRIHAVYDAVALKGILGDAHTISEAKVESYEKHRKNWKLIKEELRTKENKDEVDLWYGDLSGRQYKNPPDPEKGPDEGSKKDSPIRDSDQKQNLIKKANDYFTELIDDSQLSEEQKNCLKNDINNGQLFPVQRSSDNGVIPYQIHLNELRRIIENQKQYYPFLAETFIRKTAEGKSYEENKIVALLKFRVPYYVGPLVSKEDMEEHSSGNSAYHWMARNPGRGEAITPWNFDEVVDKDESGARFISRLTGTDTYLLGEPTLPQHSLLYEEYMVLSELNNVRLNVRQGNHWSDKNRQRLSYKQKEFLIENLFKEHKTVTRKRAEDCLSSMGCGEVQLFGLSDEKKFASSLSSYITLKKILGKAFVDDSGNSAILERIIEVQTVFEDREPLTHQLSLIDSLTVEQRKQLAKIHYTGWGKLSRKLLTSKKGSYKIHSQNEIMRTQHSIIDIMRGDSLNLIEIIRDKKIGIGEWIDNENLDRETGESDVSRLESVFEGIVMSPRVKRGVVQAVRVIDDLAKAIGNPPQRIFIEMADEVQASQRTVSRLSRLKALYGSPSLQKEFNDLKDLRKSLNETKDADLQEDRLYLYYIQLGKDLYTGKEISIDSLSSAYDIDHIVPQALTQDDSIDNRVLVSRKENARKTDSYLYTPDLIKNMRPLWGKLLAAGLMSQKKYDALTRVDDFKDREKQRFVQRSLVETRQIMKNVSTILRTYYGEDTNVVTLKSSITHDMRKYLGFPYKNRDINDYHHAQDALCISAAGQFMLNRHFVSGGEVTDGASNAYNMYLAEYLQEFRDAKARGERKRSTAFGFVVGSMSSKDDEKRTDHRTGEIVWSETNAEYLRKVMNYKKMLITQKVGDVKTRALYDETRYGHKESSAKSIKFDNLRRDTSLYGGFSGASTAYMMLVEYKKKNKLVSITAQEASLLAVADQKNDTVSVMDGILASHGLSGAKILLPKIVTGQLLDYSDALVTLQSASELNTARQMWLPRNDYNDIDIILKSKDIEDAAHKLGYDSDTVHVLRRIQKLFEAVFRVAESQFPLHQLSKDQQEEILRDPQNYGFGSAVKLLGGLLKALHANAENTNLAGLVKVLHGDKEYSDDGKAKEFKKFGFSPRWRRISNPTGFTLSDSDTFIYQSPSGIFEQRVTVKELKEKADKQK

SEQ ID NO: 1163 - protein, 116 aa, Sphingobacterium spiritivorum
MFRKYFEEKNSARLLFTLKQGDFVYVPDDNEEVILDESSPLFIDYWKNISERSNNIHVVQKFSGKEIYFLKHTIADTIAKKIEFGSQDCYQSLNGKSIKEFCIKIDSDRLGNISKV

SEQ ID NO: 1164 - protein, 1306 aa, Sphingobacterium spiritivorum; identical to SEQ ID NO: 93

SEQ ID NO: 1165 - protein, 1110 aa, Unknown
  Sphingobium sp. AP49
MAEGKKRIWRLGADLGANSLGWAAIELSAPVNGKPIAILAAGSRIFSDGRDPKSGASLAVDRRDARAMRRRRDRFKQRQKALIKYLIADGLFPADEAARNAMAAIDPYAVRARALDEALSLPELGRALFHLNQRRGFKSNRKADRKADDDAGKIAIGIDRTRDAIAEDEADAGAEPGSWTFGKWLHERRLKGQSVRTRLRPESGEDAKGDGYDFYPDRALMEEEFDAIWAAQAPHHPDVLTNDVHDRLHEIIFYQRPLKAPQVGMCSLIPGDRRLPKAHPLFQRRRLLEELNALMIVRPGEVAQRLTREERDILLLKLKDKNKVSFATLRKALKLDPDARFNKESEDRTDLKGDEVAAVMGSKTRFGNLWVHLSIEAQWDVLARLDAVESDAEDAAFCAWLVETYALTPEQARAVANAPLPPGYGRFGETATRKLIEALRDGKKDDRVLVYSEAVTEAGLGHHSDRRTGEVFEDAKGRPQLPYYGVALERHIMPGTGDPSDPEEMRVGRLTNPTVHIGLNQLRRILNVLIRAYGPPAEIAIELARELKLTDEDKKRINRENNDNRIAAERRSEKLLAIGQADSGANRALLKLWEELNPANVLDRRCIYSGRQISIDMLFSAAVEVDHILPFAATLDDSNGNKIVCLREANREKRKRSPHDAWGHSARWDEIAARAAQLPRNKRWRFEPDAMDKFRDEGGFQARHLVDTQYLARLSREYLATLYPEKGEGSGHIWVSPGRLTEMVRRKLGLNDLLPDHNFGGGADQAKNRLDHRHHAIDAVVVAIVDRGMLNAIARASGQEGAEGRERIIIPEPWDGFRDALRETVNRITVSHRTDHGTASKAGLPKGKDATAGRLHNDTAYGFTGDTDAKGNSIVVRRVPLSSFKKLADLDRIRDADLKAALYQHLNGLEGKAFEKALAEFHKLEWHNFGGVRRVRVTEPLTVIPIKDRNGRIYKGYKGDSNYRYDVWELPDGKWVTNWKNEAGEAMSSVISMFDAHQSSEPPRPHPAARKILSLHQNDLLAIEREGEDRKLMRVVKFGQSGQITLAEHQQAGDLKKRDAVSNDDDPFKYFAPTSGGLKKVKARQVRIDEIGRVLDPGFPARTARRKTRG

SEQ ID NO: 1166 - protein, 1084 aa, Sporolactobacillus vineae
MKYSIGLDIGISSVGWSVINLDRERIELMGARLFDAAENPKNGSSLAAPRRDARSARRRLRRRRYRVGRVRHFIIDRGLVTRGQADQLFDWKDGDLDIWLVRVNALERLLTDREFARVLIHIAKNRGYRSNRKSEAKSGENGQVLSAIKANKELMEEKGYQTVAEMLVNEPETFAGRKRNRGGEYTHVIARSELEHEIRLIFTKQRAFGNRFATEENENTYVKIWAAQRPVATKDDILKKIGDCTFEKGEKRAPKASYAFQYFRALDKLNRLRILSVREPSRNLTDDERNLIVPALFNHDKQKYSDLRKILQLRDDQKFNELFYDPGKSLKENENKTFLSLAEQYKIRKVIRDVQGKDGLLQYRPLDIDTIAYALTVFKDDQDTRDYLSNTFVNGNGKQVLNLANRAFDAELIDGLLSLSFAKFGHLSLKALHKLIPHMEQGLSYYDACKKVGYHDNEQVGKSKQHLLPVIPADEIRNPVVVRSLSQTRKVINAIIKRYGSPTFMYIELAREMGRPYNERRDLEKQYNKNRTVNDSAIEQIHELYPEIGAPRGHDILKYKLWQQQDCKCAYSLEKIPAEKIFEPGYAEVDHIIPYSRSFDDSNSNKVLVLSRMNQEKKNRTPYEWFGGDEHRWNKFESYVNALKVNRKKKSLLTKKNMDTEEEDTFKSRHLNDTRYITRFIKSFVEDNLLFREIEGAKQHVFTVNGAYTSLMRKRWGFNKNREESDLHHSVDAVIIAVSQPFRNEVSRYFKHREISLPQLLKRTWDYFPEPWEGFVKELRARTLQDPEKLKLALESLDLDSYDPEFIDEVKPIFISRMPKRSIKGQIHDETLRRNRGKTKDGFVKIVTRTRLENIKFDKNGDFPMYGRESDPKTYQAIKQRYLENNKDKKKAFIEPLYKPAKNPNNASLIRSVKIEDKANQIVPLRDEAVAYNASIVRTEVYRNKETGKFYLAPVYVSDVFAGREPRRFIRANVPYEQWVNITDKFTFLFNLYPNDVIYIKMKKVKTTKSNINKTISWQESYFYFKGTDIHTGAITIIDHMNSFTDRVGTQGLQLFEKYQVDPLGNLSRVHGETQYGVPALSHS

SEQ ID NO: 1167 - protein, 475 aa, Staphylococcus massiliensis
MGQDYILGLDIGITSVGYGLIDYHDKSVIDAGVRLFKEANVENNEGRRSKRGSRRLQRRRKHRLARTRNLLESYQLNPFPKCEKNPYEIRVKGFKEVLTSDELSAALLHLAKRRGIDNVHVTDTESDSSDNGLSTKEQLAKNQKALESRYVCELQLERLLNDNKVRGANNRFKTQDFVREAKQILSIQKDHHNLDQVFIDKYISLLETRREYYEGPGKGSPYGWDGDIKKWYELLMGRCTYFPESLRSVKYAYSADLFNALNDLNNLVIVRDENDKLTYPEKYHIVENVFKQRKKPTLKQIAKEIDVAPEDIRGYRVTASGTPVFTSFKLYHDIKSVTSNDKVLEDTELLDAIAEVLTIYQSPIEVQEKLESLNVILTKEEIEGISKLTGYTGTHALSLKAIQIVIDELWETNDNQMTIFTRLNMKPQKVDLAKANKIPTSLVEDFIISPVAKRAFIQSIKVINAVIKNMVCLKI

SEQ ID NO: 1168 - protein, 581 aa, Staphylococcus massiliensis
MPKDIIIELAREKNSDEERKIIRDVQKRNQQTRDLVDKVIKETGKTKAKGMVEKLILHDKQEGKCLYSLKSIPLEDLLNNPHHYEVDHIIPRSVSYDNSMNNKVLVLQEENSKKSNQTPFQYFNSSNTHITFKQFKQHVLNLSKTKDRITKKKKEYLLEERDINKFSVQKEFINRNLVDTRYATRELMTLLRAYFSANELDVKVKAINGGFTSYLRKRWDFKKDRNAGYKHHAEDALIIANVDFIFKQLKALDNAKKVMEGRKVQVEKDNVEDNEHYESLFREPDQIKEIKLYDNYKFSHRVDKKPNRELINDTIYSTRKVDNKTYTIQTVNNIYDKQNDQLKKLFNKSPEKFLMYKHDPKTFDKLATIMRQYKNEKNPLYKFHDETGEYLTKYAKKDNGPIVKSLKYIGKQVNAHLDITNDYENSNNKVVKLSLKPFRFDVYLDDGKYKFVTVKYLDIIKKDTYYVIDEEKYKLALQQKKISENAKFIGSFYNNDLIKINGELLRVIGVNDDAKNTLELNMIDISYRDYVENMNLATTPRIRKNIGKSITILEKYTTDILGNTFKISSPEKPQFIFKVRD

SEQ ID NO: 1169 - protein, 1334 aa, Staphylococcus pseudintermedius; identical to SEQ ID NO: 200

SEQ ID NO: 1170 - protein, 1112 aa, Staphylococcus simulans; identical to SEQ ID NO: 247

SEQ ID NO: 1171 - protein, 773 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQ

SEQ ID NO: 1172 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 1173 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 1174 - protein, 1378 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHHEDLKHLKQFVKASLPENYREVFADSSKDGYAGYIEGKTSQEAFYKYLLKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIIQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLGNLKSNILEEKKPKYVKDQVENHHLSDDRLFLYYLQNGKDMYTDDELDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNTSAFLESKGYLNIRDDKLMILPKYSLFELENGRRRLLASAGELQKGNELALPTQFMKFLYLASRYNESKGKPEEIEKKQEFVNQHVSYFDDILQLINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 1175 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 1176 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 1177 - protein, 1370 aa, Streptococcus agalactiae
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1178 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1179 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1180 - protein, 1370 aa, Streptococcus agalactiae
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1181 - protein, 1125 aa, Streptococcus anginosus
MNGLVLGLDIGIASVGVGILNKETGEIIHANSRIFPAATADSNVERRGFRQGRRLGRRKKHRSARLNNLFEEFGFITDFSAIPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLSPEQKRQIVEYARTAKTLGTPTLLKYIAKLVDGSIDDIKGYRIDKSDKPEMHTFDAYRKMRTLDLVNIDALSRETLDDLAHILTLNTESEGILEALNSKMPSTFTKEQIDELIQFRKKNSAVFGKGWHNFSLKLMNELISELYETSEEQMTILTRLGKQRSREISKRTKYIDEKELTEEIYNPVVAKSVRQAIKIINEATKRYGIFDNIVIEMARENNEEDAKKDYIKRQKANQDEKNASMEKAAFQYNGKKELPDSIFHGHKELATKIRLWHQQGERCLYTGKNISIRDLIHNPHQYEIDHILPLSLSFDDGLANKVLVLATANQEKGQRTPFQAIDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQFVDPETGEILSLTDDEYKELVFRPPYDYFVDTLKSKSFEDSILFSYQVDSKYNRKISDATIYGTRKAQLGKDKQEETYVLGKIKDIYSQKGYEDFIKRYNKDETQFLIYHKDPQTFEKVIEEILKTYPDKELNEKGKEIPCNPFEKYRQENGPIRKYSKKGKGPEIKSLKYYDNKLGNHIDITPVNSQNQVVLQSLKPWRTDVYFNPRTSKYELMGLKYSDLRFEKGSGSYGISPEKYNKVKAKEGVNEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKF

SEQ ID NO: 1182 - protein, 1386 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 1183 - protein, 1396 aa, Streptococcus anginosus
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 1184 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 1185 - protein, 1345 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 1186 - protein, 538 aa, Streptococcus dysgalactiae
DYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIRLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 1187 - protein, 1155 aa, Streptococcus dysgalactiae
MDKKYSIGLDIGTNSVGWAVITDDYKVPSKKFKVLGNTDRHSIKKNLIGALLFDSGETAEATRLKRSARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNRRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKYQSYKMEK

SEQ ID NO: 1188 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 1189 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 1190 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKPINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 1191 - protein, 1370 aa, Streptococcus gallolyticus; identical to SEQ ID NO: 204

SEQ ID NO: 1192 - protein, 1375 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 1193 - protein, 1368 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 1194 - protein, 1392 aa, Streptococcus mitis
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPGFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 1195 - protein, 1134 aa, Streptococcus mutans
MANGKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNMRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIVKLVGCSADDIKGYRIDKSDKPEIHTFEAYRKMRTMELIKVDDLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKKAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKSYVKGLKTLSNKKKDYLLTEENIDKIEVKQKFIERNLVDTRYSSRVVLNALQDFYKERKFDTKISVVRGQFTSQLRRKWRIEKTRETYHHHAVDALIIAASSQLNLWKKQNNPLISYKEDQFVDPETGEILSLSDDEYKKLVFKAPYEHFVDTLKSKKFEDSILFSYQVDSKYNRKISGATICGTRKAQLGKDTQEETYVLGKIKDIYSQKGYEDFIKKYKKDKTQFLMYHKDPQTFEKVIEEILKTYPDKELNEKGKEVSCNPFEKYRQENGPVRKYSKKGNGPEIKSLKYYDEVLGKNIDITPKNSLNKVVLRSLNPWRTDVYFNHETRKYEFLGLKYSDLRYLKGEHRYGILIGDYKKIKDKEGIEKESEFKFTLYKNDLILIKDTAKGKEELFRFWSRTGKDNAKTFEKNKIELKPYSKSQFEKGEDTNVLGKLYASSNQLQKSFGTLENLSIYKVRTDVLGNKYFIKKEGDKPQLNFKKKL

SEQ ID NO: 1196 - protein, 1134 aa, Streptococcus mutans; identical to SEQ ID NO: 1195

SEQ ID NO: 1197 - protein, 1128 aa, Streptococcus mutans
MANSKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNIRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIAKLVGCSADDIKGYRIDKSDKPEIHTFEAYRKMRTMELIKVADLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKEAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKAYVKGLKTLSNKKKDYLLNEEDINKNEVKQKFIERNLVDTRYSSRVVLNTLQDFYKKREFDTKISVVRGQFTSQIRRKWRIEKTRETYHHHAVDALIIAASSQLNLWKKQNNPLISYKEDQFVDPETGEILSLSDDEYKELVFKAPYDHFVDTLKSKKFEDSILFSYQVDSKYNRKISDATIYGTRKARLGKDSQEETYVLGKIKDIYSQKGYEDFIKKYKKDKTQFLMYHKDPQTFEKVIEEILKTYSDKELNEKGKEVPCNPFEKYRQENGPVRKYSKKGNGPEIKSIKYYDNKLGNHIDITPNNSHHQVVLQSLKPWRTDVYFNPKSGKYELMGLKYSDLRFEKVSGDYGISVKKYNEIKSKEGVDENSEFKFTLYKNDLILIKDTESGEQELFRFLSRTMPNQKHYVELKPYDKSKFEGHQKLMDIFGEVAKGGQCLKGLNKSNISIYKVKTDVLGNKYFIKKEGDQPQLNFKKKI

SEQ ID NO: 1198 - protein, 1128 aa, Streptococcus mutans; identical to SEQ ID NO: 1197

SEQ ID NO: 1199 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1200 - protein, 1338 aa, Streptococcus mutans; identical to SEQ ID NO: 1199

SEQ ID NO: 1201 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1202 - protein, 1345 aa, Streptococcus mutans; identical to SEQ ID NO: 1201

SEQ ID NO: 1203 - protein, 1229 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNIQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHY

SEQ ID NO: 1204 - protein, 1229 aa, Streptococcus mutans; identical to SEQ ID NO: 1203

SEQ ID NO: 1205 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 1206 - protein, 1350 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYSFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRIRKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 1207 - protein, 1350 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRICKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 1208 - protein, 1345 aa, Streptococcus mutans; identical to SEQ ID NO: 1205

SEQ ID NO: 1209 - protein, 1350 aa, Streptococcus mutans; identical to SEQ ID NO: 1206

SEQ ID NO: 1210 - protein, 1350 aa, Streptococcus mutans; identical to SEQ ID NO: 1207

SEQ ID NO: 1211 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 1212 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1213 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1214 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 1215 - protein, 1345 aa, Streptococcus mutans; identical to SEQ ID NO: 1211

SEQ ID NO: 1216 - protein, 1345 aa, Streptococcus mutans; identical to SEQ ID NO: 1212

SEQ ID NO: 1217 - protein, 1345 aa, Streptococcus mutans; identical to SEQ ID NO: 1213

SEQ ID NO: 1218 - protein, 1345 aa, Streptococcus mutans; identical to SEQ ID NO: 1214

SEQ ID NO: 1219 - protein, 1345 aa, Streptococcus mutans; identical to SEQ ID NO: 1212

SEQ ID NO: 1220 - protein, 1345 aa, Streptococcus mutans; identical to SEQ ID NO: 1212

SEQ ID NO: 1221 - protein, 1345 aa, Streptococcus mutans; identical to SEQ ID NO: 1212

SEQ ID NO: 1222 - protein, 1345 aa, Streptococcus mutans; identical to SEQ ID NO: 1212

SEQ ID NO: 1223 - protein, 1359 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADKKLRKRSGKLATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKNLDHDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 1224 - protein, 1359 aa, Streptococcus mutans; identical to SEQ ID NO: 1223

SEQ ID NO: 1225 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 1226 - protein, 1355 aa, Streptococcus mutans; identical to SEQ ID NO: 1225

SEQ ID NO: 1227 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1228 - protein, 1345 aa, Streptococcus mutans; identical to SEQ ID NO: 1227

SEQ ID NO: 1229 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1230 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1231 - protein, 1345 aa, Streptococcus mutans; identical to SEQ ID NO: 1230

SEQ ID NO: 1232 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1233 - protein, 1345 aa, Streptococcus mutans; identical to SEQ ID NO: 1232

SEQ ID NO: 1234 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1235 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 1236 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1237 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 1238 - protein, 1345 aa, Streptococcus mutans; identical to SEQ ID NO: 1237

SEQ ID NO: 1239 - protein, 1345 aa, Streptococcus mutans; identical to SEQ ID NO: 1234

SEQ ID NO: 1240 - protein, 1345 aa, Streptococcus mutans; identical to SEQ ID NO: 1235

SEQ ID NO: 1241 - protein, 1345 aa, Streptococcus mutans; identical to SEQ ID NO: 1236

SEQ ID NO: 1242 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1243 - protein, 1345 aa, Streptococcus mutans; identical to SEQ ID NO: 1242

SEQ ID NO: 1244 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1245 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1246 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1247 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1248 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1249 - protein, 1345 aa, Streptococcus mutans; identical to SEQ ID NO: 1248

SEQ ID NO: 1250 - protein, 1345 aa, Streptococcus mutans; identical to SEQ ID NO: 1244

SEQ ID NO: 1251 - protein, 1345 aa, Streptococcus mutans; identical to SEQ ID NO: 1245

SEQ ID NO: 1252 - protein, 1345 aa, Streptococcus mutans; identical to SEQ ID NO: 1246

SEQ ID NO: 1253 - protein, 1345 aa, Streptococcus mutans; identical to SEQ ID NO: 1247

SEQ ID NO: 1254 - protein, 1345 aa, Streptococcus mutans; identical to SEQ ID NO: 1246

SEQ ID NO: 1255 - protein, 1345 aa, Streptococcus mutans; identical to SEQ ID NO: 1246

SEQ ID NO: 1256 - protein, 1345 aa, Streptococcus mutans; identical to SEQ ID NO: 1246

SEQ ID NO: 1257 - protein, 1345 aa, Streptococcus mutans; identical to SEQ ID NO: 1247

SEQ ID NO: 1258 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 1259 - protein, 1345 aa, Streptococcus mutans; identical to SEQ ID NO: 1258

SEQ ID NO: 1260 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1261 - protein, 1345 aa, Streptococcus mutans; identical to SEQ ID NO: 1260

SEQ ID NO: 1262 - protein, 1350 aa, Streptococcus mutans
MKKPYSIGLDIGTNSVGWAVVTDDYKVPAKKMTVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKTPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 1263 - protein, 1350 aa, Streptococcus mutans; identical to SEQ ID NO: 1262

SEQ ID NO: 1264 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1265 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1266 - protein, 1345 aa, Streptococcus mutans; identical to SEQ ID NO: 1265

SEQ ID NO: 1267 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 1268 - protein, 1345 aa, Streptococcus mutans; identical to SEQ ID NO: 1267

SEQ ID NO: 1269 - protein, 1355 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLNKLGGD

SEQ ID NO: 1270 - protein, 1355 aa, Streptococcus mutans; identical to SEQ ID NO: 1269

SEQ ID NO: 1271 - protein, 1125 aa, Streptococcus mutans
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLEAAKLLKEIAKLVGCQVEEIKGYRLDNKDKPDLHTFEPFRKLKSNLTTIAVENLSITTLDTLAHILTLNTEREGIEEAIQKELPNIFSDEQITGIIAVRKKNSQIFGKGWHSFSIKLMKELIPELYETSEEQMTILIRLKKVKTNSKITNRTKYINEQEVTDEIYNPVVSKSIRQTVKIINAAIKKYGAFDQIVIEMPRESNEEDERKFIADLQKSNAKEKDDAMKQAALLYNGKAELPHGVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 1272 - protein, 1125 aa, Streptococcus mutans
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLGAAKLLKEIAKLVGCQVEEIKGYRLDNKDKPDLHTFEPFRKLKSNLTTIAVENLSITTLDTLAHILTLNTEREGIEEAIQKELPNIFSDEQITEIIAVRKKNSQIFGKGWHSFSIKLMKELIPELYETSEEQMTILTRLKKVKTNSKITNRTKYINEEEITDEIYNPVVSKSIRQTVKIINATIKKYGAFDQIIIEMPRESNEEDERKFIADLQKSNAKEKDDAMKQAALLYNGKDELPHDVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 1273 - protein, 1125 aa, Streptococcus mutans; identical to SEQ ID NO: 1272

SEQ ID NO: 1274 - protein, 1125 aa, Streptococcus mutans; identical to SEQ ID NO: 1271

SEQ ID NO: 1275 - protein, 670 aa, Streptococcus oralis
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIGKIDKNFYRRLDESFRVLGDKSEDIQIKQPFFGNKELETAYHKKYPTIYHLRKHLADADKNSPVADIREVYMALSHIFKYRGHFLTLGKIDPNNINMQNSWIDFIESCQDAFDLEISDESKTIAAIFKSSDNRQEKVKGILSYFQPELAKKDKSIFKQLLQLLFGLKTKFKECFELEEEPDLNFSKENYDENLENLLGTLEEDFPDVFAKLKILRDTILLSDMLTYTGATHARFSATMVERYEEHRKDLQRFKSFVKQNLSEQDYLDIFGRKTPNGFDVDKETKGYVGYISNKMVLTNKQKTIQQNFYDYISGKITGIEGAEYFLNKISDGTFLRKLRTTDNGTIPNQIHAYELEKIIERQGRDYPFLLENKDKLLSILTFKIPYYVGPLAKGNNSRFAWIKRTTSQDVLDNNDEDTKNGKIRPWNYHKLINMDETRDAFITNLIGNDIILLNEKVLPKRSLIYEEVMLQNELTRIKYKDKYGKIHFFDSELRQEIINNLFKTNSKRVSSAMLLAYLENFTNLQAVEIVSGIEKGKSLNSTLKTYNDLKTIFSEDLLDSEIYQKELEEIIKVITVFV

SEQ ID NO: 1276 - protein, 1373 aa, Streptococcus oralis
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 1277 - protein, 1371 aa, Streptococcus oralis
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 1278 - protein, 1121 aa, Streptococcus oralis
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKCRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKEYELMGLKYSDLSFEKGSGKYSISNEKYNSIKRIEGVNEQSEFKFTLYKNDLILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 1279 - protein, 1134 aa, Streptococcus oralis
MNGLVLGLDIGIASVGVGILEKNSGKIVHASSRIFPAATADNNVERRKNRQARRLHRRKKHRGARLKDLFEYYGLLTDFSKVSINLNPYRLRVDGLDQQLTNEELFIALKNIVKRRGISYLDDASEDGGTVSSDYGKAVEENRKLLAEQTPGQIQLERFEKYGQLRGDFTVVENSEKCRLINVFSTSAYKKEAERILRKQQEFNNQITDEFIEDYLKILTGKRKYYHGPGNEKSRTDYGRFRTDGATLDNIFGILIGKCTFYPNEYRASKASYTAQEFNLLNDLNNLTVPTETKKLSEEQKKTIIEYAKSAKTLGASTLLKYIAKMIDASVDQIRGYRVDVNNKPEMHTFEVYRKMQSLETISVGELSRNILDELAHILTLNTEREGIEEAINTKLRDSFSQDQVLELVQFRKNNSSLFSKGWHNFSLKLMMELIPELYETSEEQMTILTRLGKQKSKETSKRTKYIDEKEVTEEIYNPVVAKSVRQAIKIINEATKKHGIFDNIVIEMARENNEEDAKKDYIKRQKANQDEKYAAMEKAAFQYNGKKELPDNIFHGHKELATKIRLWHQQGEKCLYTGKSIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLVDTRYSSRVVLNALQDFYKNHNFDTTISVVRGQFTSQLRRKWGLEKSRETYHHHAVDALIIAASSQLRLWKKQNNPLIAYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKAGKLVDFNPFEKYRQENGPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQFFRFWSRTGKDNPKSFEKHKIELKPYEKAKFEKGEELEVLGKVPPSSNQFQKNMQIENLSIYKVKTDVLGNKHFIKKEGDKPKLKF

SEQ ID NO: 1280 - protein, 550 aa, Streptococcus oralis
MYSLDKNGSPTPLYRDQLNQYEVDHIIPYSFLPIDSIDNKVLTHRENNQRKLDNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATIRKYLYSNIMRFFNNPDSKVSKDIWDCNRDLPIIKDIIYNSQVNFVKRTMIKKGAFYNQNPVGKFNKQIAANNRYPLKTKVSSLDTSIYGGYGPMNSALSIIIIAERFNEKKCKIETVKEFHDIFIIDYKKFNNDPFQFLNDTSENGFLKKNNINRVLAFYRVPKYSLMQKIDGTRMLFESKSNLHKATQFKLTKTQNELFFHMRRLLTKSNLMDLKSESAIKESQNFILKHKEEFDNISNQLSAFSQKMLGDTTSLKNLIKGYNERKIKEINSSEETIKYFYDNFIKMFSFVKSGAPKDINDFFNNKYTVARMRPKPDKKLLNATLIHQSITGLYETRIDLSKLGED

SEQ ID NO: 1281 - protein, 1140 aa, Streptococcus parasanguinis
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 1282 - protein, 1374 aa, Streptococcus pseudoporcinus
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 1283 - protein, 1052 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 1284 - protein, 1368 aa, Streptococcus pyogenes; identical to SEQ ID NO: 37

SEQ ID NO: 1285 - protein, 1367 aa, Streptococcus pyogenes; identical to SEQ ID NO: 241

SEQ ID NO: 1286 - protein, 1368 aa, Streptococcus pyogenes [sequence omitted]

SEQ ID NO: 1287 - protein, 1370 aa, Streptococcus ratti
MKKPYSIGLDIGTNSVGWAVITDDYKVPAKKMKVLGNTDKNYIKKNLLGALLFDSGNTAEDRRLKRTARRRYTRRRNRLLYLQDIFSDEMNKVDESFFHRLEDSFLVSEDKRGDHHPIFGNVVDEVKYHEQFPTIYHLRKYLADTPEKADLRLVYLALAHMIKFRGHFLIDDPKLDVKNTDSQELFSQFLTAYDVTQEDSHLADVKINISDIITEKMNKSRKVEALLFHFPSQKKNSFFGNLVSLVFGLLPNFKTNFNLAEDAKLQLSKDSYDEDLENLLGQIGDEYTDVFVAARKLYDSILLSGILTVNDLSTKAILSASMVRRYEEHNKDLAKLKAFVKANFTHDVFKEVFSDASKNGYAGYIEGKTSQEDFYKYVKNLIGKVDGSADFIEKIDREDFLRKQRTFDNGSIPHQVHLAEMKAILRRQGEYYPFLKEHAEKIQQILTFRIPYYVGPLDRHGHSDFAWASFNSEEKVTPWNFEEIIDKNKSAQAFIERMTNQDLYLPNEKVLPKHSPLYEKYTVYNELTKIKYVTETGTAKFFDANLKQEIFDGLFKKERKVTKRKLLTFLEKNFDEFRIVDIQGLDKETETFNASYGIYQDLLKIIKDKAFMDDSENADILEDIVLTLTLFEDREMIKQRLAKYADLFDKKVIDNLARRRYTGWGRLSAKLLNGIRDKRSRKTIMDYLVDDGRSNRNLMQLITDDNLTFKDEIAKAQYSDNSDDLHQVVQDLAGSPAIKKGILQSVKIVDELVKVMGYEPEQIVVEMARENQTTAKGRRNSQQRYKRLEEAIKNLDRDLNYKILKEHPTDNQALQNDRLFLYYLQNGRDMYTGESLDINRLSDYDIDHIIPQAFIKDNSIDNRVLVSSAKNRGKSDDVPSEDVVNRMRPFWNKLLNCGLISQRKYSNLTKKELTPNDKAGFIKRQLVETRQITKHVARILDEHFNKEFDEDKKRIRKVKVVTLKSNLVSNFRKEFELYKVREINDYHHAHDAYLNAVVAKALLMKYPKLEPEFVYGEYPKYNSYRERKTATQRMFFYSNIMNMFKSKVKLADERIIERPMIEVNDETGEIAWDKTKHIATVKKVLSYPQINIVKKVEEQTGGLTNETIYPRGSFDKLLNRKNTLEASKYGGFGSPTVAYCVLVVADSKNENGKVKKLKLGSELLGITILEKNDFENNSLDFLSRKGYQGVQEKKIIKLPKYSLFEFQDGSRRMLSSVMANDNKRGDLQKANEMILPAYLVKLLYHAKHINSVGEPAHKNYINEHCSEFQDLLNYIRQFADKFVDVDKNLSKIRSLSKSMAEYSVSEICSSFVNLLTLTALGAPADFKFFGTTIPRKRYGSPQSILSATLIHQSITGLYETRIDLSKLGED

SEQ ID NO: 1288 - protein, 1135 aa, Streptococcus salivarius
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLACDIADIKGYRIDKSDKAEIHTFEAYRKMKTLETIDIEQIEREKLDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFKAHKIDTKVSVVRGQFTSQLRRHWGIDKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYALGTKTPSKTGFYKFLDLYNKDKSQFLVYQKDRKTWDEVIEKIMEQYRPFKESDKNGKEVDFNPFEKYRIENGPIRKYSRKGNGPEIKSLKYYASKLGNHIDITPKDSNNKVVLQSVSPWRADVYFNKTTGSYEILGLKYADLQFEKGTGTYRISEEKYNDIKKKEGVDSDSEFKFTLYKNDLLLIKDTETKEQRLFRFLSRSMPNKKHYVELKPYSKDKFEKNESLIEILGSADKSGRCIKGLAKSNLSIFKVRTDVLGNQHIIKNEGDKPKLDF

SEQ ID NO: 1289 - protein, 1127 aa, Streptococcus salivarius
MSDLVLGLDIGIGSVGVGILNKVTGEIIHKNSRIFPAAQAENNVERRINRQGRRLTRRKKHRRVRLNHLFEESGLITDFTNVSINLNPYQLRVKGLTDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITNVKNEKAMGPAKLFKYIAKLLSCDVADIKGYRIDKSDKAEIHTFEAYRKMKTLATIDIEQMERENLDKLAYVLTLNTEKEGIQEALEHEFADGTFSQEQIDELVQFRKANSSIFGKGWHSFSVKLMMELIPELYATSEEQMTILTRLGKQKTTSSSNKTKYIDEKQLTEEIYNPVAAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEIDHILPLSITFDDSLANKVLVYATANQEKGQRTPYQALDSMDDAWSFRELKAFVRDSKALSNKKKEYLLTEEDISKFDVRKKFIERNLVDTRYASRVVLNALQEHFRVHKTDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYSQTGYDAFIKIYKKDKSKFLMYRHDPQTFEKVIEPILENYPNKELNEKGKEVPCNPFLKYKEDHGYIRKYSKKGNGPEIKSLKYYDSKLGNHIDITPKNSNNKVVLQSVSPWRADVYFNKTTGKYEILGLKYADLKFEKGTGTYKISEEKYNDIKIKEGVDSDSEFKFTLYKNDLLLIKDTETKEQQLFRFLSRTMPNVKHYVELKPYDKQKFDDNEELIKILGIVAKGGQCKKGVSKPNISIYKIRTDVLGNQHIIKNEGDKPKLDF

SEQ ID NO: 1290 - protein, 1385 aa, Streptococcus salivarius
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKVYHDEFPTIYHLRKHLADSSKKADLRLVYLALAHMIKYRGHFLIEGDFNSKNNDLQKNFQDFLDTYNAIFESDLSLENSKQLEEIVKDKISKSAKKDRILKLFPGEKNSGIFSEFLKLIVGNQADFRKYFNLDEKTSLQFSKESYDEDLETLLGHIGDDYSDVFLKAKKLYDAILLSGILTVTDNGTEAPLSSAMIMRYKEHEEDLALLKAYIRNISLETYNEVFKDNTKNGYAGYIDGKTSQEDFYVYLKRLLAGLEGADYFLEKIDREDFLRKQRTFDNGSIPYQIYLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYENFTVYNELTKVRFIAEGMRDYQFLDSKQKKDIVRLYFKGKRKVTDKDIIEYLHAIDGYDGIELKGIEKQFNSSLSTYHDLLNIINDKEFLDDSSNETIIEEIIHTLTMFEDREMIKQRLSKFDNIFDKSVLKKLSRRHYTGWGKLSAKLINGIRDEKSGNTILDYLIDDGVSNRNFMQLIHDDALSFKKKIKKAQIIGDKDNIKQVVKSLPGSPAIKKGILQSIKIVDELVKVMGREPESIVVEMARENQYTNQGKSNSQQRLKRLEESLKGLGSKILKENVPTRLSKIDNNALQNDRLYLYYLQNGKDMYTGEELDIDRLSNYDIDHIIPQAFLKDDSIDNKVLVSSASNRGKSDDVPSLEVVKKRKTLWYQLLKSKLISQRKFDNLTKAERGGLSQEEKAGFIQRQLVETRQITKHVARLLDERFNNKKDENNRTLRTVKIITLKSSLVSQFRKDFELYKVREINDFHHAHDAYLNAVVASALLKKYPKLEPEFVYGDYPKYNSFRERKSATEKVYFYSNIMNIFKKSIPLADGTVIDRPLIEVNEETGESVWNKVADLNTVRKVLSYSQVNIVKKVEEQNHGLDRGKPKGLFNANLSSKPKPNSKENLVGAKEYLDPKKYGGYAGISNSFAILVKGTIEKGAKKKITNVLEFQGISILDRIYYRKDKLNFLLEKGYKDIELIIELPKYSLFELSDGSRRMLASILSTNNKRGEIHKGNQIFISQKFVKLLYHAKRISSTFNENHRKYVENHKKEFEELFYYILEFNENYVGAKKNGELLKSAFQSWQNHSIDELCSSFIGPTGSERKGLFELTSRGGAADFEFLGVKIPRYRDYTPSSLLKDATLIHQSVTGLYETRIDLGKLGED

SEQ ID NO: 1291 - protein, 1392 aa, Streptococcus sanguinis
MENKNYSIGLDIGTNSVGWAVITDDYKVPSKKMKVFGNTDKHFIKKNLIGALLFDEGATAEDRRLKRTARRRYTRRKNRLRYLQEIFSEEISKLDSSFFHRLDDSFLVPKDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFSDEKSTSLFSEFLKLIVGNQADFKKHFDLEEKAPLQFSKDTYDEDLENLLGQIGDGFTDLFLVAKKLYDAILLSGILTVTDPSTKAPLSASMIERYESHQKDLAALKQFIKNNLPKRYNEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKQTGDTILDYLIDDGKINRNFMQLINDDGLSFKEIIQKAQVVGKTDDVKQVVQELPGSPAIKKGILQSIKIVDELVKVMGYAPESIVIEMARENQTTARGKKNSQQRYKRIEDSLKNLAPGLDSNILKENPTDNIQLQNDRLFLYYLQNGKDMYTGKPLDIDQLSSYDIDHIIPQAFIKDDSIDNRVLTSSKDNRGKSDNVPSLEVVQKRKAFWQQLLDSKLISERKFNNLTKAERGGLDERDKVGFIRRQLVETRQITKHVAQILDASFNTEVNEKNQKIRTVKIITLKSNLVSNFRKEFELYKVREINDYHHAHDAYLNAVVAKAILKKYPKLEPEFVYGDYQKYDLKRYISRFKPSKEIEKATEKYFFYSNLLNFFKEEVHYADGIIVKRENIEYSKDTGEIAWNKEKDFATIKKVLSYPQVNIVKKTEIQTHGLDRGKPKGLFNSNPSPKPSEDSKENLVPIKQGLDPRKYGGYAGISNSYAVLVKAIVEKGAKKQQKTILEFQGISILDKINFENNKENYLLKKRYIEILSTITLPKYSLFEFPDGTRRRLASILSTNNKRGEIHKGNELVLPGKYTTLLYHAKNINKKLEPEHLEYVEKHRNDFAKLLECVLNFNDKYVGALKNGERIRQAFTDWETVDIEKLCFSFIGPENSKNAGLFELTSQGSASDFEFLGVKIPRYRDYAPSSLLKATLIHQSITGLYETRIDLSKLGED

SEQ ID NO: 1292 - protein, 1377 aa, Streptococcus sanguinis
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 1293 - protein, 1370 aa, Streptococcus sanguinis
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 1294 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 1295 - protein, 317 aa, Unknown
  Streptococcus sp. GMD4S
FEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 1296 - protein, 1420 aa, Unknown
  Streptococcus sp. oral taxon 071 str. 73H25AP
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIEKIDKNFYRRLDESFRVLGDKSEDIQIKQPFFGNKELETAYHKKYPTIYHLRKHLADADKNSPVADIREVYMVLSHILKYRGHFLTLGKIDPNNINMQNSWIDFIESCQDAFDLEISDESKTIAAIFKSSENRQEKVKQILSYFQQELLKKDKSIFKQLLQLLFGLKTKFKDCFELEEEPDLNFSKENYDENLENLLGALEEDFSDVFAKLKILRDTILLSSMLTYTGATHARFSATMVERYEEHRKDLQRFKSFVKQNLSEQDYLDIFGRKTPTGFDVDKETKGYVGYISNKMVLTNPQKQKTIQQNFYDYISGKITGIEGAECFLNKISDGTFLRKLRTTDNGAIPNQIHAYELEKIIERQGRDYPFLLENKDKLLSILTFKIPYYVGPLAKGNNSRFAWIKRTTSQDVLDDNDEDTRNGKIRPWNYHKLINMDETRDAFIINLIGNDIILLNEKVLPKRSLIYEEVMLQNELTRVKYKDKYGKIHFFNSELRQEIINNLFKTNSKRVSSAMLLSYLENFTNLQAVEIVSGIEKGKSLNSTLKTYNDLKTIFSEELLDSEIYQKELEEIIKVITVFDDKKSIKNYLTKYFGHLEFLNEEKINQLSKLRYTGWGRYSGKLLLGIRDEDTGFNLMQFLRNDDENRNLTQLISDTTLSFDSAIKAIQSKSTVEDDVFEEIKNLAGSPAIKRGILNSIKIVDELVQIIGYPPQNIIIEMARENMTTEEGQKKAKTRKSKLESALKNIEDSVLESGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATLRKHLYSNIMRFFNNPDSKVSKDIWDCNRDLPIVKDVIYNSQINFVKRTMIKKGAFYNQNPVGKLNKQIAANNRYPLKTKVSSLDTSIYGGYGPMNSALSIIIIAERFNEKKGKIETVKEFHDIFIIDYEKFNNNPFQFLNNVSEEGFLKKNDLNRVLAFYRISKYSLMQKIDGTRMLFESKSNLHKVTQFKLTKTQNELFFHMKRLLTKSNLMDLKSESAIKESQNFIQTHQNEFDNIADRLSNYSQKMLGETKSLQTLINGYNERPIKQIDNNEETIRYYYDNFIKMFSFVKSGAPKDIINFFNDKYTVPRMRPKPDRKMLDATLIHQSITGLYETRIDLSKLGED

SEQ ID NO: 1297 - protein, 1371 aa, Unknown
  Streptococcus sp. F0441
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 1298 - protein, 93 aa, Unknown
  Streptococcus sp. BS35b
MILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 1299 - protein, 1121 aa, Unknown
  Streptococcus sp. GMD6S
MNGLVLGLDIGIASVGVGILEKNSGKIIHANSRLFPAATADNNVERRKNRQARRLHRRKKHRGVRFQDLFEDYGLLTDFSKVSINLNPYRLRVDGLNQQLTNEELFIALKNIVKRRGISYLDDASEDGGTVSSDYGKAVEENRKLLAEQTPGQIQLERFEKYGQVRGDFTVVENGEKRRLINVFSTSAYRKEAERILRKQQEFNSKITDEFIEDCLKILTGKRKYYHGPGNEKSRTDYGRFRTDGTTLDNIFGILIGKCTFYPDEYRASKASYTAQEFNLLNDLNNLTVPTETKKLSEEQKKVIVEYAKEAKTLGASTLLKYIAKMIDASVDQIRGYRVDVNNKPEIHTFEAYRKMQSLETISVGELSRNVLDELAHILTLNTEREGIEEAINTKLKDSFSQDQVLELVQFRKNNSSLFSKGWHNFSLKLMMELIPELYETSEEQMTILTRLGKQKSKEISKRTKYIDEKELTEEIYNPVVAKSVRQAIKIINEATKKHGIFDNIVIEMARENNEEDAKKDYIKRQKANQDEKNAAMEKAAFQYNGKKELPDSIFHGQKELATKIRLWHQQGEKCLYTGKNIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 1300 - protein, 1026 aa, Unknown
  Streptococcus sp. BS35b
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKRRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFIDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKKYELMGLKYSDLSFEKGSGKYSISNEKYNSIKRIEGVNEQSEFKFTLYK

SEQ ID NO: 1301 - protein, 1377 aa, Unknown
  Streptococcus sp. C300
MNNKPYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLEEKAPLQFSKDTYDEDLENLLEQIGDDFADLFVAAKKLYDAILLSGILTVTDPSTKAPLSASMIERYENHQKDLAVLKQFIKTNLPEKYVEVFSDQSKDGYAGYIDGKTTQEAFYKYIKNLLSKFDGADYFLDKIEREVFLRKQRTFDNGSIPHQIHLQEMNTILRRQGEHYPFLKENKEKIEKILTFRIPYHVGPLARGNRDFAWLTRNSDQAIRPWNFEEIVDKASSAEDFINKMTNYDLYLPEEKVLPKHSLLYETFAVYNELTKVKFIAEGMRDYQFLDSGQKKKIINQLFKKKRKVTEDDIIDCLQKIDNYDGIELKGIEKQFNASLSTYHDILKIIRDKEFMDDPKNGDILENVIHTLTIFEDREMIKQRLAQYNSIFDEKVIKALSRKHYTGWGKLSAKLIDGIRDKQTGKTILDYLMDDGKSNRNFMQLIKDDELSFTEIIQKAQVVGDTDNLRQVVQNLPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGEALNINQLSSYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNKEVTEKNKKNRNVKIITLKSNMVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLIPIKSGLSPEKYGGYARPTIAYSVLVTYKQNNKIKNTMVGIPVLTKLEFERDPNLYLRNLGINNVSHVIKLVKYTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLSKLGED

SEQ ID NO: 1302 - protein, 1371 aa, Unknown
  Streptococcus sp. oral taxon 056 str. F0418
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 1303 - protein, 1139 aa, Unknown
  Streptococcus sp. C150
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLSCDVADIKGYRIDKSDKAEIHTFEAYRKMKTLETLDVKKMAREELDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFRTHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKDKSQFLMYQKDRRTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQIFRFWSRTGKDNPKSFEKHKLELKPYEKTRFEKGEELKVLGKVPPSSNRLQKNMQIENLSIYKVRTDVLGNQHIIKNEGDKPKLDF

SEQ ID NO: 1304 - protein, 1375 aa, Unknown
  Streptococcus sp. M334
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 1305 - protein, 206 aa, Unknown
  Streptococcus sp. GMD4S
RTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATR

SEQ ID NO: 1306 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWDEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 1307 - protein, 1381 aa, Streptococcus suis
MVKKKYAIGIDIGTNSVGWSIVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDRYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYEPEHIVVEMARENQFTNQGRRNSQQRINRLENALKDFGSKILEEQKPYGVSKVNNIHLQSDRLFLYYLQNGKDMYTDEELDIDHLSEYDIDHIIPQAFIKDDSLDNKVLTKSAKNRGKSDDVPSMEIVHNRKNFWRQLLKSKLISQRKFDNLTKAERGGLTNEDKARFIQRQLVETRQITKHVARMLDTRFNTKLDEAGNRIRDPKVNIITLKSNLVSQFRKDYQLYKIREINNYHHAHDAYINAVVATALLKKYPQLAPEFVYGEYPTYNSYNSRKSATEKVLFYSNIMNFFKRIVVHSKTGEVRIRPVIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVETHRHVFDELLIYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 1308 - protein, 39 aa, Streptococcus thermophilus
GRCIKGLGKSNISIYKVRTDVLGNQHIIKNEGDKPKLDF

SEQ ID NO: 1309 - protein, 302 aa, Streptococcus thermophilus
MIRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAERFILSKPIEK

SEQ ID NO: 1310 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLGNHIDITPKDSNNKVVLQSVSPWRADIYFNNTTGKYEILGLKYADLQFEKGTGTYKISQEKYNDIKKKEGVDSDSEFKFTLYKNDLLLVKETETKEQQLFRFLSRTMPKQKHYVELKPYDKQKFEGGEALIKVLGNVANGGQCIKGLGKSNISIYKVRTDVLGNQHIIKNEGDKPKLDF

SEQ ID NO: 1311 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKEYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASIQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPVNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 1312 - protein, 1121 aa, Streptococcus thermophilus
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFVNRYLEILTGKRKYYHGPGNEKSRTDYGRYRTNGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILKRLGKQKTTSSSNKTKYIDEKLLTEEIYNPVVAKSIRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNDPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 1313 - protein, 1122 aa, Streptococcus thermophilus
MSDLVLGLDIGIGSVGVGILNKVTGEIIHKNSRIFPAAQAENNVERRTNRQGRRLTRRKKHRRVRLNRLFEESGLITDFTKISINLNPYQLRVRGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKASSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKLSDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRADVYFNKTTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 1314 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVCEINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 1315 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 1316 - protein, 595 aa, Streptococcus thermophilus
MVQFRKANSSIFGKGWHNFSVKLMMELIPELYETSEEQMTILKRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQFLDIETGELISDDEYKESVFKAPYQHFVDTLKSKEFEDSILFSYQVDSKFNRKISDATIYATRKAKLDKEKKEYTYTLGKIKDIYTQAGYDAFIKIYKKDKSKFLMYHHDPQTFEKVIEPILENYPNKEINEKGKEVPCNPFLKYKEEHGYIRKYSKKGNGPEIKSFKYYDNLLGRHIDITPKNSKNIVALRKLNPWRTDVYFNHETMKYEFLGLKYADISYKKSKNKAGDFLPK

SEQ ID NO: 1317 - protein, 1388 aa, Streptococcus thermophilus]
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 1318 - protein, 1038 aa, Streptococcus vestibularis
MIDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSEEQKNQIINYVKNEKAMGPAKLFKYIAKLLSCDIADIKGYRIDKSDKAEIHTFEAYRKMKTLETIDIEKMSREELDKLAYVLTLNTEREGIQEALEHEFVDGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARATNEDDEKKAIQKIQKANKDEKDAAMLKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKNKSQFLMYQKDRKTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQVFRFWSRTGKDNPKRFEKHKIELKPYEKARFEKGEELEVLGKVPPSSNQLQKNMQIENLSIFKVRTDVLGNQHIIKNEGDKPKLDF

SEQ ID NO: 1319 - protein, 97 aa, Streptococcus vestibularis
MSDLVLGLDIGIGSVGVGILNKVTGEIIHKNSRIFPAAQAENNVERRTNRQGRRLTRRKKHRRVRLNHLFEESGLITDFTKVSINLNPYQLRVKIDR

SEQ ID NO: 1320 - protein, 1084 aa, Unknown
  Subdoligranulum sp. 4_3_54A2FAA
MKNTLYGIGLDIGVASVGWAVVGLNGTGEPVGLHRLGVRIFDKAEQPKTGESLAAPRRMARGMRRRLRRKALRRADVYALLERSGLSTREELAQMFEAGGLEDIYALRTRALDEPVGKAEFSRILLHLAQRRGFKSNRRTASDGEDGRLLAAVNENRRRMAQGGWRTVGEMLYRHEAFALHKRNKADDYLSTVGRDMVAEEASILFERQRAMGCSWAAPELQAEYLSILLRQRSFDEGPGGNSPYGGNQVEKMVGRCTFEPDEPRAAKAAYSFEYFSLLQKLNHIRLAENGETRPLTQPQRQQLLSLAHKTPDISLARIRKELALPETVQFNGVRCRANETLEESEKKEKFACLPAYHKMRKALDGVVKGRISSLSISQRDAAATALSLYKNEDTLRAKLTEAGFQAPEIDALAGLTGFSKFGHLSLKACRKLIPHLEQGLTYDQACTAAGYDFKGHGAGERAFTLPAAAPEMEQITSPVVRRAVAQTIKVVNGIIREMDASPAWVRIELARELSKTFGERQEMDRSMRENAAQNERLMQELRDTFHLLSPTGQDLVKYRLWKEQDGVCAYSLRRLDVERLFEPGYVDVDHIVPYSLSFDDRRSNKVLVLSSENRQKGNRLPLQYLQGKRREDFIVWTNSSVHDYRKRQNLLREKLSGDEAEGFRQRNLQDTQHMARFLYNYISDHLAFAQSEALGKKRVFAVSGAVTSHLRKRWGLSKVRADGDLHHALDAAVVACTTDGMIRRISGYYGHIEGEYLQDADGAGSQHARTKERFPAPWPRFRDELIVRLSEQPAEPLLDINPEFYCEYGTEHIRPVFVSRMPRRKVTGPGHKETIKGAAAADEGLLTVRKALTELKLDKDGEIKDYYMPSSDTLLYEALKAQLRRFGGDGKKAFAEPFYKPKADGTPGPLVRKVKTTEKATLTVPVHGGAASNDTMVRVDVFLVPGDGYYWVPVYTADTLKPELPNRAVVQGKPYSEWKEMREEDFIFSLYPNDLVYVEHKSGLKFTLQNADSTLEKTRTQTSAFAYFVSGSISTASITIRTHDNAYGIPSLGVKTLKTFHKYQVDVLGNVFPVHKETRQKFR

SEQ ID NO: 1321 - protein, 951 aa, Sutterella parvirubra
MPTVRPVFHSSASFDLGAKNTGLFLVNHPAGAAPSAEYAAAYTIVQPADGDGLNYSTTNRRAVRHRLRGGKRFKLARRLVLQVIDALRKLKPGLIRDEEMRRTVEALSSLLKRRGFTRIESEAQVDPTTLDSVDPAVFADHETLGGFFSLGIPISTQWDALSQNPGAVEQLFKALPSAKDFGKYVTEQFPEFAEQKKLYADAIKVLSSEAKSIVMQLGLGHHHRSKYFEMIAHDMLRDPRLQGVFELFGSEERFKTFICNVSNLQLRALRWYFDEPNPEVANQWNPEKFQVVWLRGLKYFHPDAERKADMKKLIDELTASKDILDALCTTDPRRTIPPYEDQNNRRPPFDQTLWLSAAELTRRYGDKWRIWSQKFERADRALSTGLDEILLYTDRRSRMFNRNQDPSVYADSYVLQRVLDRSSKLDRYALRALAAGYRTQELHEPLATLSDTLGTQHVETFLTFAAEYYEEVAAAKNGLWLDGPSRLLERADIHPPMKKKVLDLLLGNILDATPEIGRILRTVLWNRHVHEKSRSTPASLCRSIEAIRKDFGGEFRMRYDALDAKIRAAEDQKKKFKPTNAEEKDLFKAWNATKTMHAFLRDVLQLTPKQLERTASPYVFAQLHTLIDTERDGFTSTSLAAHLENHWRMRANAAGMAQCSRLPADAVRPFDGVLSKALDRQAFEAAKLAAQHLMSRKELTDTDIRYSIIIESNRFAFSASTAELKKNTLAKKNAEKGLNFELKRWQDKDSRIREASRGICAYTGAKLGDVVEYDHIIPRAFTTSAMGSVFNSEANLICVSRPGNQTKADKRYGLNKLHKTYLTAVFGTADVTTIAASIEDIVGKLASANRLRHFELLNEKEQDAVRHALFLDDESDARRIVLRELAAQNKSRVNGTQAWFVRAFMTKLLEITKDWRERTGNTLDIRSWKTDAEVASRLRSALNFHAEITLT

SEQ ID NO: 1322 - protein, 406 aa, Sutterella parvirubra
SNLFREEVPYGDHFLPIIQMKNRIYIGYQLPKADGTGGNAVAVLGKDPLELLETLKPFLDREPQAFSDHPVTYKMINERAYELLTKCALTPDQTTELERTQAEVLRSLNYQTSRAAVLGRLVDDKNKFVAKDAVWKEKDFVISFKLSPKKSAFKASGQLELPAKSDWKALVDSPELAINWGQPADDTFSQRIERKVRMNSSHLEHTPKKRVVSLPVVDKPSGGFRIRRHNLDGSAVFQVHTVANNKYGGFSADSAGKVDWSTPVLCGHLQHANLVPLDPETASAEQLVRMSEWRVVETTSDIRLEVCPGTSGRRYVRVELPFTLLQEWLTAGKVADVPVSPLHLPGSIKLTDPKTFCAEAQKTLSIFAQPRATIFFEQLGDRVRFRFEASGGPATMNAAYNAAGRS

SEQ ID NO: 1323 - protein, 389 aa, Sutterella wadsworthensis
MKACDLEEKTNHLQACVAIDLGARYTGTFSILHKSSHLPSKDDCRAATYVLPEDGGKMTYSQRNRTAVRHRIRGKKRFALARRMAMLIIREKLAAKSVTLTSSETRRLAEAVGSLLRRRGYNRLETETDNDLTVLENIEPEVFSEHEILGKYFYAGTDLAIQWETLSQDLSKISSLLAERLSEKDFKKYLTGLIPDDKNKIKHIISVFKMLIDEAESINMQCVLGHKHRTQYLSDIHADMHRDTRLSKAAEAFGGVDRLWRLLGNLSNLQLRAHRWYFNAPHLFDDQALEPARLQKTLVRAFKYLHCPQGVESRAQAELVKELEEADDIIDALCTIDPVRTIPPYENQQNRRPPFDQTLYLSPDLGVSGFLCLGRLFQGQPNEAALCFL

SEQ ID NO: 1324 - protein, 976 aa, Unknown
  Tannerella sp. 6_1_58FAA_CT1
MKKILGLDLGSNSIGWALVNEAENRDEASSIIKLGVRVNPLTVDEMQNFEKGKSITTNADRTLKRSMRRNLQRYKLRRDALIKLLKKVGFITDGTILSEQGNRTTFETYRLRAKAPDEEISLQELARVLLMINKKRGYKSSRKIKEKEAGTLIDGMEVAKKLYDEDLTPGQLCLQLLESGKKSLPDFYSSDLQEEFDRIWNFQKQFNPKAFCDTAKEEIKGKNKSQTWAILAKYFIWMEEMDVWNEKESKTERVEKECKLVGLKRTVKKEEQRKENYCWRVQALTEQLDLEKVAVVLQEINGQISTSSGYLGAISDRSKVLYFNRQTVGQYQMAELEKNPNTSLRNMVFYRQDYLDEFDKIWEKQAEFHKELTVELKKEIRDIIIFYQRRLKSQKGLIGFCEFENREIMVEKNGKMQAKVVGCKVIPRSHPLFQEFKIWQTLNNVEVFAGEKKCKRKRTDAFPGLFDGTEDTLMVEGWRYLYQEEKEILAKELSVKKSLKKEYILKLLFDNPQDLDMNFEQIEGNDTGNVLFSAYSKMIEKYGYEPLDFGKPTDKIIEQLQVIFADLGWNTDLLFVDLNKEGKDLEKQPYFKLWHLLYSFEGDNTPTGNGKLVEKLMELCHVGKECALELVNISFQNDYGSLSAKAIKKILPYLKEGNRYDVACGYAGYRHSKSSLTKEEIENKVLKDKLDILPKNSLRNPVVEKILNQMVNVINAIIDTYGKPDEIRVELARELKKSAKEREELTKAIAKSTREHEEIRKVLQEEFGMINVSRNDIIRYKLYKELKDNGYKTLYSNQDIPKEKVFSKEIDIEHIIPQARLFDDSLSNKTLEYKAINIEKGNKTAYDFVKEKYGEKGLQQYLNRCESLFKGHRTKLRKLKMGQENIPEGFIDRDLRNTQYIAKKALAMLNEICRRVVATTGSITDRLREDWQLVDVLKELRCFRYFKDTKMKANHNKNIFYTSIKVDVSDTSKILK

SEQ ID NO: 1325 - protein, 1049 aa, Tistrella mobilis
MINERLTFGIDLGIGSCGWAVLRHADAAGEPGVIEGLGSWCFDVPETSKERIPTNQVRRSNRLLRRVIRRRRNRMAEIRRLFHAQGLLPSADEDALKRPRLDPWELRARGLDQCLSAEEFAVALGHIARHRGFRSSAKRKAANTSGEDSKMLSALLVTRERTARYRTVGEMFARDPEYSARRRNRDGIFDRTVARDDLIHEVGKLFEAQRARGSAFASPDLEADFNAIAFRQAEMQDSERLVGNCPFERDEKRAARWAPSFERFRLLTRLINLRIATAEGERRFTPEDLARVSAELGATAKLPVSRVRALIGLLPDERFTTIRVEDEDRDIVARTGEAAPGTWRLRKTLGEALWAEMQARPDQLDAIAHVLSFFEATAKIRSELDRLGLPAAVIEALDRGLEDGAFAKFKGAGHISAKACRNLLPHLQQGHRYDQACRLAGYDHAASTLSHTAQVVSKAGFNALVTELGESIANPIARKALTEGLKQIRAMCARWGLPGAIHIELAREVGNSIEKRRELESQRETTTKRRQTERDEIRGLLALEDVDDDTLLRYRLWKEQGGKCLYTGKDIHVRQLIATDNSVQVDHILPWSRFGDDSFNNKTLCLASANQRKRGQTPWEWFSLTGTPEAWEVFASRVETSKDLRGFKKRNLLLKNADEVAQRFRSRNLNDTRYAARLLAEAAKLFYPAGDRQEKDGRRRVLTRPGPLTAALRHAWGLESLKKADGKRVSDDRHHALDALAVAAISEREVQRLTRSFQEWEQQGLARPLRHVAPPWPGFRGDVLAAYAQAFVARPERRRARGKGHDASIRQVVGEGPEAQVFERRGLADLKEADLDRVKDPERNQAIIEAVRAWILAGRPADAPPRSPRGDVIVKLRTAPAKKIKPAVPVRGGTADRGDMVRIDVFTRPNRKGRDEWYLVPIYPHQVMNRKAWPHPPMRSVVAYKDEAGWTEIGAEHSFRFSLYPRSYVQLVKSNGDVIEGYLVSMDRSTGAFRVFVHNNPAEMAKGIGAKTLLNLRKFNVDRFGVRTEVKSEVRTWHGEVCTSPVPPD

SEQ ID NO: 1326 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSELQHIGGSKYSGVAKIGNKISSLDNCILIYQSITGIFEKRIDLLKV

SEQ ID NO: 1327 - protein, 769 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKCCGRL

SEQ ID NO: 1328 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 1329 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGAFSNISKYGGYNKVSAAYYTLIEYEEKGNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNPDNCILIYQSITGIFEKRIDLLKV

SEQ ID NO: 1330 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMELDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSAYVGVCKITHKKLVIKNSASQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 1331 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKFNRLTRATPISDDETAKFIARQLVETRQATKVAARVLEKMFPETKIVYSKAETVSMFRNKFDIVKCREINDFHHAHDAYLNIVVGNVYNTKFTNNLWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 1332 - protein, 357 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQAFFEYLREDMEVDIDADSQKIKEILKDSSLKNSEKQSRLNKILGLKSSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKITTITPDM

SEQ ID NO: 1333 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPNDYKKVFGYNKNEKNNNNYSAYVGVCKTKSKKLVINNTVNQEDFYKFLKPILLAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKNSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDSLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 1334 - protein, 631 aa, Treponema denticola
MLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLRSEIQSKQRGFWNFLQRNNFISLEKLNRLTRTTPISDDETAKFIARQLVETRQATKVAAKVLEKMFPETKIVYSKAETVSMFRNKFDIVKCREINDFHHAHDAYLNIVVGNIYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKENKIRSLETIPLYLVKDIQKSQEKLKSYLTDLLGKKEIKILVPKIKINSLLKINGFPCHITGKTNDSFLLRPAVQFCCSNDEVLYFKKIIRFNEIRSQREKMGKTISPYEDLSFRSYIKENLCKKTKNDEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 1335 - protein, 631 aa, Treponema denticola
MLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 1336 - protein, 370 aa, Treponema denticola
MTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEDIIRWAAIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKCCGRL

SEQ ID NO: 1337 - protein, 591 aa, Treponema phagedenis
MARGKEAEKGRTSSRYASIKALYENCKQDLADYDAVLEQFKSEEPLRLRSDKLYLYYTQLGRCMYTGRVIDIDRLMSDNSAYDIDHIYPRSKIKDDSLTNRVLVVKDANQDKRDEPLSPQIQDKQKGFWDFLKHNNFISIEKYERLTYRGYFTEEMLSGFIARQLVETRQGTKTAGQILEQLYPDSTVVYCKAANTSEFRQKFNLIKCREINDLHHAHDAYLNIAVGNVYYTKFTSNPRNFMKLKEPYNLRELFDRDVERNNTIAWVKNKTITTIKDMLKRNTPLYTRYAYCKTGGFFDQNIMKKGKGQFPLKENSPLSDISKYGGYNKVSGAYFILVQKKEKDAVVRILETVPLYLLNKPGKESENVREYLSTALGTKDFKILIPKIKINSLFKINGFLVHITGKTNDRFLVRSAVQFFCDDNLTLFFKRIIAFNGLRNLNKDKSMTAYDDNTMRVYVRGNLFKDKNQLFDKNKFNEIVKGKNISVYKDMVKRYETSIYKFRPNTAVIPILKSGEDKFINLPIEEQFKILQEILKLFGAINGTANLTLIGGRPSTGEMKISNNISNLKQCILIHQSPTGVFEQQIDLLKI

SEQ ID NO: 1338 - protein, 1062 aa, Unknown
  Treponema sp. JC4
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEKIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 1339 - protein, 281 aa, Treponema vincentii
MKTLGLDIGTNSIGWGIVDETANKIEDCGVYIFPEGVKKEKGNESSKAAERTSFRLARRLKFRRKLRKCETLKVLIKNKMCPLTMEELEKWRKQKIYPVSQDFLNWYRTDELKNWEPYFLRKKCAEQKAGPYEIGRALYHLAQRRGFLSNRKESTKASDGKVSKSIDELSSLMDGRTLGQYFYELKQSGEKVRGKYTSRKEHYEKEFNKICEVQEISPELKDDLYRAIFFQRKLKSQKFLVGKCTFERNKPRAPISHFEFEEFRMLSFINSIKIAKKLRRR

SEQ ID NO: 1340 - protein, 675 aa, Unknown
  uncultured bacterium T3_7_42578
MTAENYSNVRFAFDIGTNSIGWAVFQLNDKQEATSILNAGARIFSDGRDPKTFEPLAVRRRNVRSASRMRDRYLRRRKRTLDKLIGYGLLPEDKAERDKILLETNDKPSGSTDKKTDPYSLRARALEEKLPLAYVARALFHIGQRRGFKSNRKADRKSNEKGKIAAGIEELSGLMHQSHAPTLGAYLAKRREEGHVVRLRASSEALTNKAYAFYPERAMLEDEFHKIWQAQAEYYPDVLTKEREEELFHVMFFQRPLKEQKVGLCTLVEGELRLPKSDPLFQQFRLYKEINELAIILPDLSQRKLTMEERDTLITLMRPAKTKTFAALRKALKIPAGGRFNKETENRKQLTGDEVYSVFSKPELFGGDWAKFSIEQQREIIDQLNNEENPDKLEEWLKNKFPKLSDEQRSEIINANLPDGYGRFGITATSKILEQLKKDVISEAEAAHRCGFDHSLANRNWKGLDELPRYQEVLERHIVPGTGDKNDIYDIYKGRLTNPTVHIGLNQVRRLTNRLIKAYGKPWQIVVELARDLPMSSEERKEHNKTLNDNIKAGFERTQKLERLGQKDNANNRLLLKLWEELGKDPDDRKSIYSGTRITEPMLFSGEVEIDHILPFSLTYDDSYANKILCLREENRIKRNRAPADVTEWKDRYDEIIGRSKNCQRTNKNVLGPMQ

SEQ ID NO: 1341 - protein, 1017 aa, Unknown
  uncultured bacterium
MRVDSLGRCLSDEEWARVIYHLCKHRGFHWISRAEAKQTEGDSKSEGGKVKQGLAGTAKLMDEKGYRSAAEMVLAEFPEAQRNKQGEYRKALSRELLAKELALLFARQRVFGNRHATDTLETAILGNSDKKSGLFWQQKPALAGADLLKMLGTCTFEKNEYRAPKASFTAERHVWLTRLNNLRIVTDGITRQLTEQERQLVLPLPYRQAGDLTYKQLGMALTKAGLLEAGCFKFIGLAYPTEAQKAEGKTKDPESATLVKIPAWQELRQTLNKASLNDEWEKLSGDALCGQPEIFDKIAWILSVYKDDDEVRTELAKLVLPNPEGLTEALLNIRFDKFHALSLKALRAIVPHMEKGLRYDEACVQAGYHHSQLHKIGEGEHKYLPPLYDGRDGDGRMIFAEDADIPRNPVVLRSLNQARKVVNAIIRRYGSPSAVHIEMARDLSRPFDERNKIKKDQDEYQARNQRDREQFIELFGHPPKGLEFEKWRLYREQNGQCAYSQKPLASSGDVAEIFLDGSTEIDHALPYSRSFDDSKNNKVLVLTRENRDKGNRTPYEYLGGAENSERWQRFFSFVESNKAYRLAKRTRLLRKDFGAKESEEFRERNLNDTRYVCRFFKNYVEQHLKLAEGSEAKRCVVVSGQLTNFLRTRWGLLKIRSDSDRHHALDAAVVAACSHSMVQRLSNYSRTRELEQVRDGFVNIETGEIVNPAMHQQLREHFPDPWPYFRHELEARLKIDSPALLREEMARLSSYTEEELAALKPLFVSRAPQRRNGGAAHKDTIYGQPEKLKKNGSVSQKVALASLALKDIDLLADPHRNAKLYGAIRERLEAHGGKGDKAFPATNPLRKPDKEGNPTGPIVRTVTKVIDKLSGIPVRGGIAKNDTMLRVDVFTKAGRFHLVPVYVHHRVTGLPNQAITRGKDENQWAIIDDTFEWRFSLYPNDLVQIRLKDETHLGYYASTDRSTSSISIWAHDRNQSVGKDGLIRSIGVTTAKDIEKFHVDTLGNVYPAPPEKRRGLA

SEQ ID NO: 1342 - protein, 600 aa, Unknown
  uncultured bacterium
VNAIIKKHGSLSAVHIEMARDLSRPLDERREVKKLQEEFKDRNDKARESFEADHGYRPKGIVFEKWMLYREQHGKCAYSMEGLDIDRVLNDANYAQIDHALPYSRSYDDSKNNKVLVLTRENQNKGNRTAYEYLTSFAGGEDGDRWRNYAAWVNSNKSYRMAKRNRLLRKNYGPDEASGFKDRNLNDTRYICKFFKNYVEEHLQLAPRADGNANKRCVVVNGQLTAFLRARWGLSKVRSESDRHHALDAAVVAACSHGMVKALADYARNKEVAYLREGFPDPETGEIINPEAHARGVHHFPEPWAHFRHELQVRLYSDDLQALREDLQRLGTYSEQDLLGVRTLFVSRAPQRRNDGAVHKETIYAQPEALRKQGGVVQKVPLTSLSLKDLDNLADPHRNAKLYTALRARLEAHGGKADKAFGPDQPFYKPDKNGNPTGPIVRTIKLVIDKLSGIPIRGGVAKNDTMLRVDVFTKAGKFHLVPVYVHHRVTGLPDRAIVAFKDEVEWTQVDDSFKFLFSIHPNDLIRIGLKAKEPMIGYFASCHRGTGAFNVWSHDRNTSVGKSGSVEGIGIKTALSLEKLNIDVLGNVYPARPEQRHGLA

SEQ ID NO: 1343 - protein, 1011 aa, Unknown
  uncultured delta proteobacterium HF0070_07E19
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 1344 - protein, 1011 aa, Unknown; identical to SEQ ID NO: 1343
  uncultured delta proteobacterium HF0070_07E19

SEQ ID NO: 1345 - protein, 1120 aa, Unknown
  Veillonella sp. oral taxon 780 str. F0422
MGFKANLVNLFTDEDIEVILPEEKEFKSINLHEGIYEDVRDAYEDAWGDRFAIVDQCKVLHDIIVISSIIKPGQSLSEAKIESYNQHKEDLVLLKSVLKEDRKLYDDMFVVDTDKGTNYVKYTKQGVNGNTSATQEEFYKYVRKVVSVLPETEHTRRIVQKLEEGTFLPLQRISKNGVVPYQLHKEELVRILDKATVNFPFLNKVENGLTVADKIISILEFKIPYYVGPLNPTHSIENGGFAWVVRKEAGQVLPWNFEQKVDVQASAVKFIENLTNKCTYLIDQDVLPKYSLLYAEFSLLNELNNIRVNDKPLPADVKQAFIRDHFISLQDSKTATKKVVAKYLVDNNYVSQPPIITGMDQQIATKLTSHRDMTRILGEHFDHAMAEDIIRYITIFGESKDMLRQVLKNYYGDRLTTEQIKKLGKLTYTGWGRLSKKFLSDIWGMKKNDDDAEAGTIIEHMREGQENLMQLLSSSYSFIDVVQEYVTNVLGEKEKTAFEMLEDLSLSPMVKRSVWQTLRILDEIVSIRKELPKKIFVEVARTNKADKKRTQSRKALLEELYKQIKDEDVHVLQQELESKEDSALNSKKLYLYFTQMGRCMYSGRRIDIHELFTDKYDIDHIYPRSLTKDDSWHNIVLVEKQLNAEKTDRFPILSAIQSKQKGFWKLLWDRGFISEKKYDRLVRTTDLTDEELNQFINRQMVSTNQSVKAVTTLLHQLYPETEVVFSKAENVSDFRHDYDFVKVRSINHHHHAKDAYLNIVVGNVYHEKFTKNFLSFAKQKGTRRTYNLTKIFEYEIKLTEESKKVIWDPNIHMDIVKKMMKSNDVRVTQRAVPQKGGLSDETIYKKGIAKRGVYLPLKSSDERVRDVEKYGGRTSITISEYIILNIRDTSDQDRIEIFSLPLYIAGKKDIHKAIEEAYLSTCKKPASVVDIQILYRGLYIGSKVNINGFTYYMGGKTGSNVSIDSAVDVVMDITSSVYIKLLEKVAIKKIENPKTFRIENIKTSYNHKEVTVSKEQNIALYQELLKKLDTPLFSKMKGNKLEEFRTVGFDTFIALSLEEQASVLLEVLNVLTNFKTKRDITKIGMTSSRSTLGINISNTEQFSVITTSITGLYEQEIKIK

SEQ ID NO: 1346 - protein, 983 aa, Verminephrobacter aporrectodeae
MRRRRDRLLKRKARMHDQLMRHGFFPADAAGRKVLERLNPYQLRAKGLHQALTPGEFARALFHINQRRGFQSNRKTDRKDNESGALKQAISELRAQIHDSGCATVGEWFWKERMQQKPEGVHRQGVRARYRETPYTTDEGRQRIDKRYDLYVDRAMIEQEFDALWAVQAALQPGLFTDAACKELRYTLLFQRKLRPVKPGRCTLLPEEERAPLALPSTQRFRILQEVNHLRLLDEALREVPLTLAQRDALVAALESQGKLGFAPMRKLLKLPGTVKFNLEDEKRTELKGNATSAILARKDLFGPAWAGFDAALQDEIVWQLVSEEGEGRLIAWLQQHTGVDEARAEAIADTSLPEGYGSLSRKALERIVPALQREVCSYDKAVQAAGFAHHSDLGFDFEHSGDEVQQVGERIIASTGEVRPLFAFKQLPYYGKALQRHVAFGSGKPEDPEEKRHGKIANPTVHIGLNQVRTVVNALIRRYGRPSEVVVELARDLKQSREQQQETQRKQAENQRRNTRIRERIAETLGISPERVRSSDIQKWILWEELSFDVVDRRCPYSGEQISTTMLLSPKVEIEHILPFSQTLDDSLNNRTVALREANRIKRNRTPWDARADFEARGWSYEGILHRAERMPLRKRYRFAPDGYQRWLGEDKDFLARALNDTRYLSRVAANYLRLVCPKPQGVRVIPGRMTAMLRAKFGLNDVLGLDGEKNRNDHRHHAVDACVIGVTDQGLMQRFARASAQAREDGLTRLVQDMPLPWPSYRDHVERAVRHIWVSHKPDHGFEGAMMEETAYGIRKDGSIKPRRKADGSAGREVVNLIRITESRQPVRHGVDSQGQPLPYKGYVGGSNYCIEITANDQGKWEGAVISTFEAYRIVRASGWGRLRHCSHGQNGRPLMMRLMIGDAVRLALDGSEKTMRVVKISANGQVFLVAPNEANVDARNRDKADPFAYVSKKAGSFQSAKARQVSISPIGELRDPGFKG

SEQ ID NO: 1347 - RNA, 94 nt, artificial  sequence
  Synthetic nucleic acid sequence
guuuucccuuuucaaagaaaucuccugggcaccuaucuucuuaggugcccucccuuguuuaaaccugaccaguuaaccggcugguuagguuuuu

SEQ ID NO: 1348 - RNA, 22 nt, artificial  sequence
  Synthetic nucleic acid sequence
gagauuuaugaaaagggaaaac

SEQ ID NO: 1349 - RNA, 36 nt, artificial  sequence
  Synthetic nucleic acid sequence
uaaucccacagccgccaguuccgcuggcggcauuuu

SEQ ID NO: 1350 - DNA, 10 bp, artificial  sequence
  Synthetic nucleic acid sequence
aagccaaaaa

SEQ ID NO: 1351 - DNA, 15 bp, artificial  sequence
  Synthetic nucleic acid sequence
tcttcattgcgctta

SEQ ID NO: 1352 - RNA, 73 nt, artificial  sequence
  Synthetic nucleic acid sequence
aacagcauagcaaguuaaaauaaggcuaguccguuaucaacuugaaaaguggcaccgagucggugcuuuuuuu

SEQ ID NO: 1353 - DNA, 20 bp, artificial  sequence
  Synthetic nucleic acid sequence
gcagcagaagaagcctttgt

SEQ ID NO: 1354 - DNA, 20 bp, artificial  sequence
  Synthetic nucleic acid sequence
ttcctcctctccctcctctc

SEQ ID NO: 1355 - RNA, 125 nt, artificial  sequence
  Synthetic nucleic acid sequence
  misc_feature (13)..(112): n at each of these positions can be present or absent such that this region can contain anywhere from 3 to 100 nucleotides. n is a, c, g, or u
guuuuagagcuannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnuagcaaguuaaaa

SEQ ID NO: 1356 - RNA, 123 nt, artificial  sequence
  Synthetic nucleic acid sequence
  misc_feature (12)..(111): n at each of these positions can be present or absent such that this region can contain anywhere from 3 to 100 nucleotides. n is a, c, g, or u
guuuagagcugnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaaguuaaa

SEQ ID NO: 1357 - RNA, 124 nt, artificial  sequence
  Synthetic nucleic acid sequence
  misc_feature (13)..(112): n at each of these positions can be present or absent such that this region can contain anywhere from 3 to 100 nucleotides. n is a, c, g, or u
guuuuagagcugnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgaguuaaa

SEQ ID NO: 1358 - RNA, 128 nt, artificial  sequence
  Synthetic nucleic acid sequence
  misc_feature (14)..(113): n at each of these positions can be present or absent such that this region can contain anywhere from 3 to 100 nucleotides. n is a, c, g, or u
guuuuuguacucunnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagcuacaaagau

SEQ ID NO: 1359 - RNA, 122 nt, artificial  sequence
  Synthetic nucleic acid sequence
  misc_feature (12)..(111): n at each of these positions can be present or absent such that this region can contain anywhere from 3 to 100 nucleotides. n is a, c, g, or u
guuguagcuccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnguugcuacaau

SEQ ID NO: 1360 - RNA, 42 nt, artificial  sequence
  Synthetic nucleic acid sequence
guuuuagagcuagaaauagcaaguuaaaauaaggcuaguccg

SEQ ID NO: 1361 - protein, 15 aa, artificial  sequence
  Synthetic sequence
IGLDIGTNSVGWAVI

SEQ ID NO: 1362 - protein, 8 aa, artificial  sequence
  Synthetic sequence
IVIEMARE

SEQ ID NO: 1363 - protein, 27 aa, artificial  sequence
  Synthetic sequence
DVDHIVPQSFLKDDSIDNKVLTRSDKN

SEQ ID NO: 1364 - protein, 8 aa, artificial  sequence
  Synthetic sequence
HHAHDAYL

SEQ ID NO: 1365 - protein, 15 aa, artificial  sequence
  Synthetic sequence
IGIDLGGKFTGVCLS

SEQ ID NO: 1366 - protein, 8 aa, artificial  sequence
  Synthetic sequence
MMQRLAYE

SEQ ID NO: 1367 - protein, 33 aa, artificial  sequence
  Synthetic sequence
EIDHIYPRSLSKKHFGVIFNSEVNLIYCSSQGN

SEQ ID NO: 1368 - protein, 8 aa, artificial  sequence
  Synthetic sequence
SHAIDATL

SEQ ID NO: 1369 - protein, 15 aa, artificial  sequence
  Synthetic sequence
IAIDLGAKFTGVALY

SEQ ID NO: 1370 - protein, 8 aa, artificial  sequence
  Synthetic sequence
IIEHIARK

SEQ ID NO: 1371 - protein, 33 aa, artificial  sequence
  Synthetic sequence
EIDHIIPRSLTGRTKKTVFNSEANLIYCSSKGN

SEQ ID NO: 1372 - protein, 8 aa, artificial  sequence
  Synthetic sequence
SHVVDAVC

SEQ ID NO: 1373 - protein, 15 aa, artificial  sequence
  Synthetic sequence
IGLDIGTNSVGWAVL

SEQ ID NO: 1374 - protein, 8 aa, artificial  sequence
  Synthetic sequence
IVVEMARE

SEQ ID NO: 1375 - protein, 27 aa, artificial  sequence
  Synthetic sequence
DIDHIVPQSFITDNSIDNLVLTSSAGN

SEQ ID NO: 1376 - protein, 8 aa, artificial  sequence
  Synthetic sequence
HHAHDAYL

SEQ ID NO: 1377 - protein, 15 aa, artificial  sequence
  Synthetic sequence
VGLDVGTNSCGWVAM

SEQ ID NO: 1378 - protein, 8 aa, artificial  sequence
  Synthetic sequence
IAIEFTRD

SEQ ID NO: 1379 - protein, 27 aa, artificial  sequence
  Synthetic sequence
DIDHILPQSFIKDDSLENRVLVKKAVN

SEQ ID NO: 1380 - protein, 8 aa, artificial  sequence
  Synthetic sequence
HHAIDAYL

SEQ ID NO: 1381 - protein, 15 aa, artificial  sequence
  Synthetic sequence
LALDIGIASVGWAIL

SEQ ID NO: 1382 - protein, 8 aa, artificial  sequence
  Synthetic sequence
IVIEMPRD

SEQ ID NO: 1383 - protein, 27 aa, artificial  sequence
  Synthetic sequence
EIDHIIPRSISFDDARSNKVLVYRSEN

SEQ ID NO: 1384 - protein, 8 aa, artificial  sequence
  Synthetic sequence
HHAVDAML

SEQ ID NO: 1385 - protein, 15 aa, artificial  sequence
  Synthetic sequence
LGLDIGITSVGYGLI

SEQ ID NO: 1386 - protein, 8 aa, artificial  sequence
  Synthetic sequence
IIIELARE

SEQ ID NO: 1387 - protein, 27 aa, artificial  sequence
  Synthetic sequence
EVDHIIPRSVSFDNSYHNKVLVKQSEN

SEQ ID NO: 1388 - protein, 8 aa, artificial  sequence
  Synthetic sequence
HHAEDALI

SEQ ID NO: 1389 - protein, 15 aa, artificial  sequence
  Synthetic sequence
IGFDLGVASVGWSIV

SEQ ID NO: 1390 - protein, 8 aa, artificial  sequence
  Synthetic sequence
VVIEMARE

SEQ ID NO: 1391 - protein, 27 aa, artificial  sequence
  Synthetic sequence
EIDHVIPYSKSADDSWFNKLLVKKSTN

SEQ ID NO: 1392 - protein, 8 aa, artificial  sequence
  Synthetic sequence
HHAVDASI

SEQ ID NO: 1393 - protein, 15 aa, artificial  sequence
  Synthetic sequence
LGLDLGIASVGWCLT

SEQ ID NO: 1394 - protein, 8 aa, artificial  sequence
  Synthetic sequence
IVVEVTRS

SEQ ID NO: 1395 - protein, 27 aa, artificial  sequence
  Synthetic sequence
DIDHIVPRSISFDDSFSNLVIVNKLDN

SEQ ID NO: 1396 - protein, 8 aa, artificial  sequence
  Synthetic sequence
HHAEDAYF

SEQ ID NO: 1397 - protein, 15 aa, artificial  sequence
  Synthetic sequence
LGVDLGISSLGWAIV

SEQ ID NO: 1398 - protein, 8 aa, artificial  sequence
  Synthetic sequence
VHFELARE

SEQ ID NO: 1399 - protein, 27 aa, artificial  sequence
  Synthetic sequence
EIDHILPRSRSADDSFANKVLCLARAN

SEQ ID NO: 1400 - protein, 8 aa, artificial  sequence
  Synthetic sequence
HHAVDAII

SEQ ID NO: 1401 - protein, 15 aa, artificial  sequence
  Synthetic sequence
LGLDLGTNSIGWAIR

SEQ ID NO: 1402 - protein, 8 aa, artificial  sequence
  Synthetic sequence
IHIEMARE

SEQ ID NO: 1403 - protein, 27 aa, artificial  sequence
  Synthetic sequence
DIEHTIPRSISQDNSQMNKTLCSLKFN

SEQ ID NO: 1404 - protein, 8 aa, artificial  sequence
  Synthetic sequence
HHTIDAIT

SEQ ID NO: 1405 - protein, 15 aa, artificial  sequence
  Synthetic sequence
LGLDLGTNSIGWAVV

SEQ ID NO: 1406 - protein, 8 aa, artificial  sequence
  Synthetic sequence
IHLELGRD

SEQ ID NO: 1407 - protein, 27 aa, artificial  sequence
  Synthetic sequence
EIEHVIPQSLYFDDSFSNKVICEAEVN

SEQ ID NO: 1408 - protein, 8 aa, artificial  sequence
  Synthetic sequence
HHAMDAIV

SEQ ID NO: 1409 - protein, 15 aa, artificial  sequence
  Synthetic sequence
LGLDLGTNSIGWALV

SEQ ID NO: 1410 - protein, 8 aa, artificial  sequence
  Synthetic sequence
IRVELARE

SEQ ID NO: 1411 - protein, 27 aa, artificial  sequence
  Synthetic sequence
DIEHIIPQARLFDDSFSNKTLEARSVN

SEQ ID NO: 1412 - protein, 8 aa, artificial  sequence
  Synthetic sequence
HHAMDALT

SEQ ID NO: 1413 - protein, 15 aa, artificial  sequence
  Synthetic sequence
LGVDVGERSIGLAAV

SEQ ID NO: 1414 - protein, 8 aa, artificial  sequence
  Synthetic sequence
IVVELARG

SEQ ID NO: 1415 - protein, 27 aa, artificial  sequence
  Synthetic sequence
ELDHIVPRTDGGSNRHENLAITCGACN

SEQ ID NO: 1416 - protein, 8 aa, artificial  sequence
  Synthetic sequence
HHAVDAVV

SEQ ID NO: 1417 - protein, 15 aa, artificial  sequence
  Synthetic sequence
IGIDVGLMSVGLAAI

SEQ ID NO: 1418 - protein, 8 aa, artificial  sequence
  Synthetic sequence
VQIEHVRE

SEQ ID NO: 1419 - protein, 28 aa, artificial  sequence
  Synthetic sequence
EMDHIVPRKGVGSTNTRVNLAAACAACN

SEQ ID NO: 1420 - protein, 8 aa, artificial  sequence
  Synthetic sequence
HHAVDAAV

SEQ ID NO: 1421 - RNA, 42 nt, Artificial Sequence
  Synthetic sequence
  misc_feature (1)..(20): n is a, c, g, or u
nnnnnnnnnnnnnnnnnnnnguuuuagagcuaugcuguuuug

SEQ ID NO: 1422 - RNA, 42 nt, Artificial Sequence
  Synthetic sequence
  misc_feature (1)..(20): n is a, c, g, or u
nnnnnnnnnnnnnnnnnnnnguuuuagagcuauguuauuuug

SEQ ID NO: 1423 - RNA, 158 nt, Artificial Sequence
  Synthetic sequence
  misc_feature (1)..(20): n is a, c, g, or u
  misc_feature (33)..(132): n at each of these positions can be present or absent such that this region can contain anywhere from 3 to 100 nucleotides. n is a, c, g, or u
nnnnnnnnnnnnnnnnnnnnguuuuagagcuannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnuagcaaguuaaaauaaggcuaguccg

SEQ ID NO: 1424 - RNA, 159 nt, Artificial Sequence
  Synthetic sequence
  misc_feature (1)..(20): n is a, c, g, or u
  misc_feature (33)..(132): n at each of these positions can be present or absent such that this region can contain anywhere from 3 to 100 nucleotides. n is a, c, g, or u
nnnnnnnnnnnnnnnnnnnnguuuuagagcuannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnuagcaaguuaaaauaaggcuuuguccg

What is claimed is:

1. A method of modifying a target DNA molecule, the method comprising:
    contacting a target DNA molecule having a target sequence with a complex comprising:
        (a) a Cas9 protein; and
        (b) a DNA-targeting RNA comprising:
            (i) a targeter-RNA that hybridizes with the target sequence, and
            (ii) an activator-RNA that hybridizes with the targeter-RNA to form a double-stranded RNA (dsRNA) duplex of a protein-binding segment,
                wherein the activator-RNA hybridizes with the targeter-RNA to form a total of 10 to 15 base pairs,
            wherein said contacting takes place outside of a bacterial cell and outside of an archaeal cell,
            thereby resulting in modification of the target DNA molecule.

2. The method of claim 1, wherein said modification of the target DNA molecule is cleavage of the target DNA molecule.

3. The method of claim 1, wherein the target sequence is 15 nucleotides (nt) to 18 nt long.

4. The method of claim 1, wherein the target sequence is 18 nucleotides (nt) to 25 nt long.

5. The method of claim 1, wherein the target DNA molecule is chromosomal DNA.

6. The method of claim 1, wherein the activator-RNA comprises the 26 nucleotide tracrRNA sequence set forth in SEQ ID NO: 441.

7. The method of claim 1, wherein the targeter-RNA and/or the activator-RNA comprises one or more of: a non-natural internucleoside linkage, a nucleic acid mimetic, a modified sugar moiety, and a modified nucleobase.

8. The method of claim 1, wherein the targeter-RNA and/or the activator-RNA comprises one or more of: (i) a non-natural internucleoside linkage selected from a phosphorothioate, an inverted polarity linkage, and an abasic nucleoside linkage; (ii) a locked nucleic acid (LNA); and (iii) a modified sugar moiety selected from 2'-O-methoxyethyl, 2'-O-methyl, and 2'-fluoro.

9. The method of claim 1, wherein the targeter-RNA and/or the activator-RNA comprises one or more of: a peptide nucleic acid (PNA), a morpholino nucleic acid, a cyclohexenyl nucleic acid (CeNA), and/or a locked nucleic acid (LNA).

10. The method of claim 1, wherein the targeter-RNA and/or the activator-RNA comprises one or more modified sugar moieties selected from: 2'-O-(2-methoxyethyl), 2'-dimethylaminooxyethoxy, 2'-dimethylaminoethoxyethoxy, 2'-O-methyl, and 2'-fluoro.

11. The method of claim 1, wherein the targeter-RNA and/or the activator-RNA is conjugated to a moiety selected from: a polyamine; a polyamide; a polyethylene glycol; a polyether; a cholesterol moiety; a cholic acid; a thioether; a thiocholesterol; an aliphatic chain; a phospholipid; an adamantane acetic acid; a palmityl moiety; an octadecylamine or hexylamino-carbonyl-oxycholesterol moiety; a biotin; a phenazine; a folate; a phenanthridine; an anthraquinone; an acridine; a fluorescein; a rhodamine; a fluor; and a coumarin.

* * * * *